(12) United States Patent
Mohr et al.

(10) Patent No.: US 9,623,059 B2
(45) Date of Patent: Apr. 18, 2017

(54) ONCOLYTIC HERPES SIMPLEX VIRUS AND THERAPEUTIC USES THEREOF

(75) Inventors: Ian J. Mohr, New York, NY (US); Matthew C. Mulvey, Baltimore, MD (US)

(73) Assignees: New York University, New York, NY (US); Benevir Biopharm, Inc., Baltimore, MD (US)

(*) Notice: Subject to any disclaimer, the term of this patent is extended or adjusted under 35 U.S.C. 154(b) by 0 days.

(21) Appl. No.: 14/343,108

(22) PCT Filed: Sep. 7, 2012

(86) PCT No.: PCT/US2012/054206
§ 371 (c)(1),
(2), (4) Date: Nov. 7, 2014

(87) PCT Pub. No.: WO2013/036795
PCT Pub. Date: Mar. 14, 2013

(65) Prior Publication Data
US 2015/0110822 A1    Apr. 23, 2015

Related U.S. Application Data

(60) Provisional application No. 61/532,335, filed on Sep. 8, 2011.

(51) Int. Cl.
| *A61K 39/00* | (2006.01) |
| *C12N 15/86* | (2006.01) |
| *C12N 7/00* | (2006.01) |
| *A61K 35/763* | (2015.01) |

(52) U.S. Cl.
CPC .............. *A61K 35/763* (2013.01); *C12N 7/00* (2013.01); *C12N 15/86* (2013.01); *A61K 2039/5256* (2013.01); *A61K 2039/572* (2013.01); *A61K 2039/585* (2013.01); *C12N 2710/16632* (2013.01)

(58) Field of Classification Search
CPC .. C12Q 1/6886; C12Q 1/6883; C07K 14/005; C07K 14/035; C07K 14/4702; C07K 14/4748; C07K 16/087; C07K 16/28; C12N 7/00; C12N 15/86; C12N 2710/16634; C12N 2760/16234; C12N 15/00; A61K 9/0019; A61K 38/00; A61K 39/0011; A61K 39/12; A61K 39/39; A61K 39/39558; A61K 39/245; A61K 2039/5256; A61K 2039/51
See application file for complete search history.

(56) References Cited

U.S. PATENT DOCUMENTS

| 7,731,952 | B2 * | 6/2010 | Mohr | C12N 7/00 424/229.1 |
| 8,252,277 | B2 * | 8/2012 | Mohr | C12N 7/00 424/229.1 |
| 8,709,397 | B2 * | 4/2014 | Mohr | C12N 7/00 424/229.1 |
| 2006/0039894 | A1 | 2/2006 | Mohr et al. | |
| 2007/0264282 | A1 | 11/2007 | Coffin | |
| 2009/0053178 | A1 * | 2/2009 | Rabkin | A61K 39/245 424/93.2 |
| 2009/0220460 | A1 * | 9/2009 | Coffin | A61K 35/763 424/93.6 |
| 2010/0092435 | A1 * | 4/2010 | Wiertz | A61K 39/25 424/93.7 |
| 2011/0070262 | A1 | 3/2011 | Johnson et al. | |
| 2011/0236415 | A1 * | 9/2011 | Mohr | C12N 7/00 424/199.1 |
| 2013/0034586 | A1 * | 2/2013 | Mohr | C12N 7/00 424/231.1 |

FOREIGN PATENT DOCUMENTS

| IL | CA 2381056 A1 * | 2/2001 | .......... A61K 39/245 |
| WO | WO 00/75292 A1 | 12/2000 | |
| WO | WO 02/076216 A1 | 10/2002 | |
| WO | WO 2005/011715 A1 | 2/2005 | |
| WO | WO 2006/002394 A2 | 1/2006 | |

OTHER PUBLICATIONS

Todo T. Oncolytic virus therapy using genetically engineered herpes simplex viruses. Front Biosci. Jan. 1, 2008;13:2060-4.*
Todo T, Martuza RL, Rabkin SD, Johnson PA. Oncolytic herpes simplex virus vector with enhanced MHC class I presentation and tumor cell killing. Proc Natl Acad Sci U S A. May 22, 2001;98(11):6396-401. Epub May 15, 2001.*
Office Action which issued Apr. 9, 2015 in corresponding European counterpart application No. 12830105.8.
Liu et al. "ICP34.5 deleted herpes simplex virus with enhanced oncolytic, immune stimulating, and anti-tumour properties", Gene Therapy, vol. 10, 2003, pp. 292-303.
Mohr et al. "A Herpes Simplex Virus Type 1 γ34.5 Second-Site Suppressor Mutant That Exhibits Enhanced Growth in Cultured Glioblastoma Cells Is Severely Attenuated in Animals", Journal of Virology, Jun. 2001, pp. 5189-5196.
Oosten et al. "TAP-inhibiting proteins US6, ICP47 and UL49.5 differentially affect minor and major histocompatibility antigen-specific recognition by cytotoxic T lymphocytes", International Immunology, vol. 19, No. 9, 2007, pp. 1115-1122.

(Continued)

*Primary Examiner* — Rachel B Gill
(74) *Attorney, Agent, or Firm* — Fish & Richardson P.C.

(57) ABSTRACT

The present invention relates to variants of herpes simplex virus (HSV) that selectively infect and replicate in cancer cells, including HSV strains that selectively infect and replicate in bladder cancer cells. Preferred HSV of the invention have intact endogenous Us11 and Us12 genes and have genes encoding ICP34.5 replaced with a gene encoding Us11 fused to an HSV immediate early (IE) promoter. The variant HSV of the invention also comprise one or more additional heterologous genes encoding immunomodulatory polypeptides. Methods and compositions using these variant HSV, for example, for treating cancer in a subject, are also provided.

64 Claims, 12 Drawing Sheets

(56) References Cited

OTHER PUBLICATIONS

Spector et al. "Mutational analysis of the promoter region of the α27 gene of herpes simplex virus 1 within the context of the viral genome", Proc. Natl. Acad. Sci. USA, vol. 87, Jul. 1990, pp. 5268-5272.
International Search Report and Written Opinion for PCT/US2012/054206 dated Jan. 28, 2013. 16 pages.
"Regulation of Herpesvirus Macromolecular Synthesis I. Cascade Regulation of the Synthesis of Three Groups of Viral Proteins1", Honess et al., Journal of Virology, Jul. 1974, vol. 14, No. 1, pp. 8-19.
"Herpesvirus Late Gene Expression: A Viral-Specific Pre-initiation Complex Is Key", Gruffat et al., Frontiers in Microbiology, Jun. 2016, vol. 7, Article 869, 15 pages.

\* cited by examiner

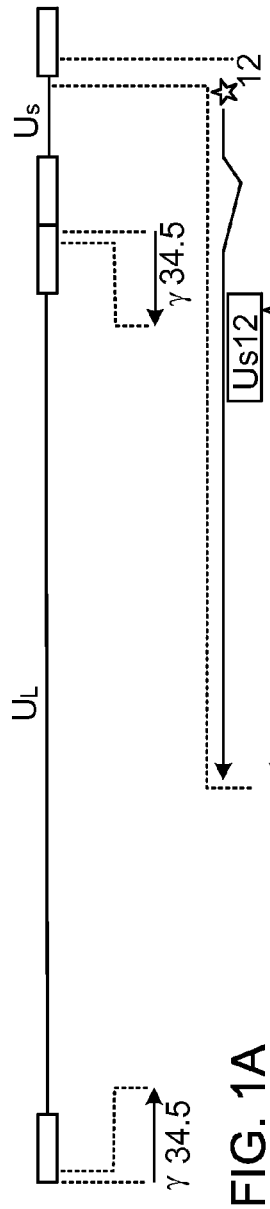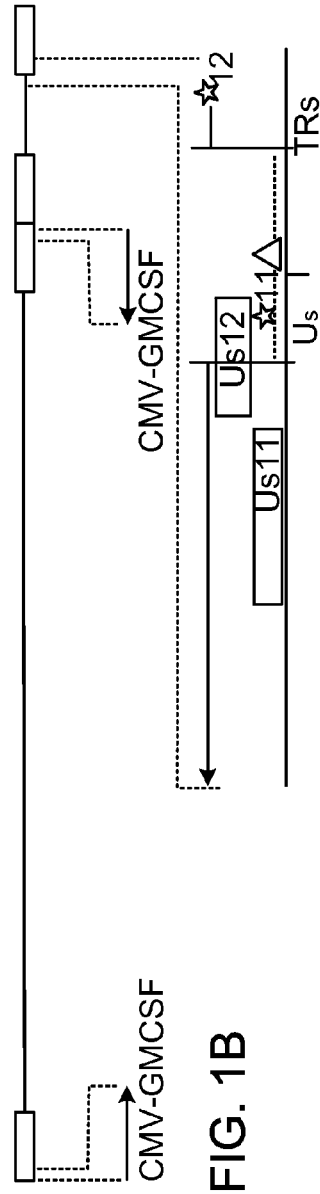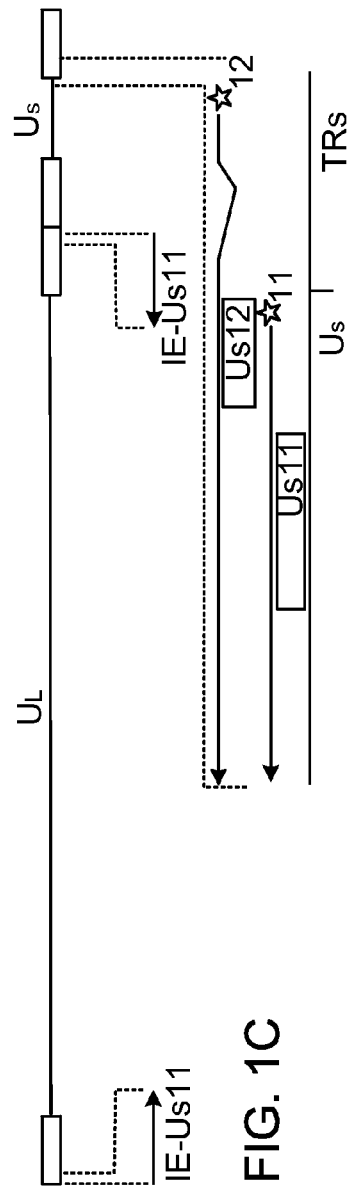

ONCOLYTIC HERPES SIMPLEX VIRUS AND THERAPEUTIC USES THEREOF

RELATED APPLICATION

This is a U.S. National Phase application under 35 U.S.C. §371 of International Patent Application No. PCT/US2012/054206, filed Sep. 7, 2012, and published as WO 2013/036795 on Mar. 14, 2013, and claims priority to U.S. Provisional application Ser. No. 61/532,335, filed Sep. 8, 2011, both of which are incorporated by reference herein in their entireties.

FIELD OF THE INVENTION

The present invention relates to avirulent, modified herpes simplex virus (HSV) that replicates selectively in cancer cells, such as bladder cancer and melanoma cells. Therapeutic methods using the modified HSV are also provided, including therapeutic methods for treating bladder, melanoma and other types of cancer.

BACKGROUND OF THE INVENTION

While the underlying goal of cancer therapy is to destroy the cancer while avoiding excessive damage to the normal organs of the body, their toxic effects to the body limit present treatments such as chemotherapy and radiation. As such, the maximal tolerable dosage of such therapies is often inadequate to eradicate the tumor. Newer treatment strategies have focused upon identifying antineoplastic agents that can distinguish normal cells from their cancerous counterparts. Oncolytic viruses replicate, spread and selectively destroy cancerous tissue, but are attenuated and do not harm normal cells. In addition to direct oncolysis, an immune-mediated component contributes to oncolytic virus efficacy in immune-competent mice (i.e., oncolytic viruses have a tumor-vaccination effect mediated at least in part through an anti-tumor CD8+ T cell response). Using immune-competent mice with syngeneic, bilateral subcutaneous (s.c.) tumors, previous studies established that treatment of one tumor with oncolytic virus (HSV-1) induced regression of the treated and untreated contralateral tumor (see Toda M, et al. "Herpes simplex virus as an in situ cancer vaccine for the induction of specific anti-tumor immunity." Hum Gene Ther 1999; 10:385-93). While treated and untreated tumors both regressed, oncolytic virus was only detected in the treated tumor. Furthermore, regression of the uninjected, contralateral tumor resulted from an anti-tumor CD8+ T-cell response.

Several different oncolytic herpes simplex virus type 1 (HSV-1) strains have proven to be safe in phase I human clinical trials. See Aghi & Martuza, *Oncogene* (2005) 24:7802-7816. Viral genetic analysis has established that HSV-1 can be effectively neuro-attenuated by deleting the $\gamma_1 34.5$ neuropathogenesis genes. Chou et. al., *Science* (1990) 250:1262-1266. The cellular interferon-induced eIF2α kinase PKR, a major innate host defense component, phosphorylates the critical host cell translation initiation factor eIF2α in response to viral infection. Phosphorylated eIF2α blocks translation initiation thereby precluding the manufacturing of viral polypeptides and progeny. The $\gamma_1 34.5$ gene encodes a regulatory subunit of the cellular protein phosphatase 1 and directs dephosphorylation of eIF2α which results in the production of viral proteins and progeny. Chou et al., *Proc. Natl. Acad. Sci. USA* (1995) 92:10516-10520; He et. al., *Proc. Natl. Acad. Sci. USA* (1997) 94:843-848.

While $\gamma_1 34.5$-deficient (Δ34.5) viruses are sufficiently attenuated and safe (see, U.S. Pat. No. 7,981,669 by Coffin et al.), their anti-tumor efficacy in animal models is severely limited by their constrained ability to replicate in many types of cancer cells.

Failure of these Δ34.5 strains to propagate an infection throughout the tumor mass allows the cancer to simply regrow. See Mohr, *Oncogene* (2005) 24:7697-7709. The HSV-1 Us11 gene has been shown to encode a function expressed very late in the viral growth cycle that antagonizes PKR and innate host defenses. Viruses engineered to express Us11 very early following infection (termed "immediate-early" of "IE") allow Δ34.5 mutant viruses to grow efficiently. Remarkably, Δ34.5 viruses that express IE Us11 (Δ34.5 IE Us11) remain just as neuro-attenauted as the parental Δ34.5 strains, yet they replicate in and efficiently destroy cancer cells, making them ideal oncolytic virus candidates. Mohr et. al., *J. Virol.* (2001) 75:5189-5196. In studies using independently constructed viruses in different tumor models, engineering a Δ34.5 mutant derivative to express IE Us11 resulted in a dramatic improvement in the ability of the virus to inhibit tumor growth. Taneja et. al., *Proc. Natl. Acad. Sci. USA* (2001) 98:8804-8808; Todo et. al., *Proc. Natl. Acad. Sci. USA* (2001) 98:6396-6401; and Liu et al., *Gene Therapy* (2003) 1):292-303.

However, the above-described Δ34.5 IEUs11 oncolytic strains have a major drawback, as engineering IE Us11 expression inactivates the neighboring Us12 gene, which encodes an important immunomodulatory polypeptide, ICP47, involved in blocking antigen presentation by inhibiting the transporter associated with antigen presentation (TAP) 1/2. Mohr et al., *J. Virol.* (1996) 75:5189-5196; Todo et al., *Proc. Natl. Acad. Sci. USA* (2001) 98:6396-6401; Liu et al., *Gene Therapy* (2003) 10:292-303. Since the Us12 gene product acts to inhibit antigen presentation, its absence results in increased clearance of infected cells by the acquired immune response. Goldsmith et al., *J. Exp. Med.* (1998) 187:341-348. Thus, Us12 is likely required to ensure that the HSV-1 oncolytic virus is not prematurely cleared before it has a chance to spread through the tumor tissue and complete its task of tumor eradication. This is especially important given the prevalence of HSV-1 and HSV-1-specific immunity (e.g., seropositivity) in the general population. Indeed, recently published studies indicate that evasion of CD8+ T cells is critical for superinfection by a herpesvirus. Hansen et al., *Science* (2010) 328:102-106. Although it is understood that Us12 prevents cytolytic T-cell recognition of infected cancer cells, it does not interfere with presentation of tumor antigens on the surface of uninfected cells or, after infection begins, down-regulate existing cell surface complexes displaying tumor antigens. Hence, expression of Us12 immunomodulatory activity enhances viral spread and oncolysis but does not diminish the overall immune response and/or potential for creating a tumor vaccination effect.

Δ34.5 IEUs11 HSV variants having intact Us12 were described in U.S. Pat. No. 7,731,952 by Mohr et al. While those Δ34.5 IEUs11 HSV variants expressed Us12, it is not possible to test those variants in murine models of, e.g., cancer, using immune-competent mice, because Us12 cannot inhibit murine TAP, leading to the premature clearance of virus-infected cells, as discussed above.

Animal models are often instructive in understanding human diseases, and it would be useful to be able to test Δ34.5 IEUs11 HSV variants in such models, especially ones that use immune-competent mice in order to more closely represent human diseases, such as cancer, in which most patients are immune-competent and may also have anti-HSV specific memory T cells. Hence, there remains a need in the art for oncolytic viruses that evade CD8+ T cells and/or avoid premature clearance by the immune system, particularly ones that can be tested in immune-competent murine and human models.

SUMMARY OF THE INVENTION

As discussed above, there remains a need in the art for variant HSV with improved anti-tumor activity, including improved viral spreading and ability to evade host immune responses, e.g., CD8+ cytolytic T cell-mediated clearance of virally infected cells, that can be tested in immune-competent murine models of disease, such as cancer.

Thus, a variant herpes simplex virus (HSV) having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) at least one heterologous gene encoding a polypeptide capable of enhancing an anti-tumor response is provided.

A heterologous gene can encode an immunomodulatory polypeptide, such as one selected from the group consisting of a TAP ½ ("TAP") inhibitor, granulocyte macrophage colony stimulating factor (GM-CSF), tumor necrosis factor (TNF)-alpha and CD40 ligand (CD40L). Other non-limiting examples of immunomodulatory polypeptides include for example, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, G-CSF, IFN-α, IFN-γ, IL-20 (MDA-7), and costimulator molecules such as B7-1 (CD80) and B7-2 (CD86).

The heterologous gene can also encode a prodrug converting enzyme. The heterologous gene can also encode an enzyme that degrades or modifies extra-cellular matrix components in order to facilitate viral spread through the tumor, for example, a matrix metalloproteinase.

A variant HSV having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) at least two heterologous genes encoding a polypeptide capable of enhancing an anti-tumor response is also provided. The at least two heterologous genes can, for example, encode a TAP inhibitor and a mammalian GM-CSF. The TAP inhibitor can inhibit a non-human TAP, such as, for example, a murine TAP. Preferably, the TAP inhibitor is the UL49.5 polypeptide from bovine herpesvirus. The at least two heterologous genes can also encode, for example, a TAP inhibitor and a prodrug converting enzyme. The heterologous gene can also encode an enzyme that degrades or modifies extra-cellular matrix components in order to facilitate viral spread through the tumor, for example, a matrix metalloproteinase.

A variant herpes simplex virus (HSV) having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) a gene encoding an inhibitor of antigen presentation on class I major histocompatibility complex (MHC) molecules, wherein said inhibitor is capable of inhibiting antigen presentation on the surface of virally infected tumor cells is also provided. Preferred inhibitors of antigen presentation are TAP inhibitors.

A variant herpes simplex virus (HSV) having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; (b) a gene encoding an inhibitor of antigen presentation on class I major histocompatibility complex (MHC) molecules, wherein said inhibitor is capable of inhibiting antigen presentation on the surface of virally infected tumor cells is also provided; and (c) a heterologous gene encoding a polypeptide capable of enhancing an anti-tumor response is also provided. Preferably, the heterologous gene encodes GM-CSF. Preferably, the IE promoter is an α27 IE promoter. In some embodiments, the heterologous gene is operably associated with a promoter selected from the group consisting of a CMV promoter and an EF1α promoter. Preferably, the TAP inhibitor is a bovine herpesvirus (BHV) UL49.5 polypeptide.

A variant herpes simplex virus (HSV) having an intact endogenous Us12 encoding gene and an intact endogenous Us11 encoding gene, lacking functional ICP34.5 encoding genes, wherein each ICP34.5 encoding gene is replaced with a polynucleotide cassette comprising a nucleic acid sequence set forth in one of SEQ ID NO: 21, SEQ ID NO: 22, SEQ ID NO: 23, SEQ ID NO: 24 and SEQ ID NO: 25 is also provided.

A variant herpes simplex virus (HSV) having a genome sequence set forth in SEQ ID NO: 26, SEQ ID NO: 27, SEQ ID NO: 28, SEQ ID NO: 29, or SEQ ID NO: 30 is also provided.

A pharmaceutical formulation comprising a variant HSV of the invention and a pharmaceutically acceptable carrier for administration to tumor cells is provided herein. Preferably, a pharmaceutical formulation comprises a variant herpes simplex virus (HSV) having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) at least one heterologous gene encoding a polypeptide capable of enhancing an anti-tumor response, and a pharmaceutically acceptable carrier for administration to tumor cells.

A pharmaceutical formulation can also comprise a variant HSV having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) at least two heterologous genes encoding a polypeptide capable of enhancing an anti-tumor response, and a pharmaceutically acceptable carrier for administration to tumor cells.

A pharmaceutical formulation can also comprise a variant herpes simplex virus (HSV) having an intact endogenous Us12 encoding gene and an intact endogenous Us11 encoding gene, lacking functional ICP34.5 encoding genes, wherein each ICP34.5 encoding gene is replaced by a polynucleotide cassette comprising: (a) a Us11 encoding gene operably associated with an immediate early (IE) promoter; and (b) a gene encoding an inhibitor of antigen presentation on class I major histocompatibility complex (MHC) molecules, wherein said inhibitor is capable of inhibiting antigen presentation on the surface of virally infected tumor cells and, optionally, (c) a heterologous gene encoding a polypeptide capable of enhancing an anti-tumor response, and a pharmaceutically acceptable carrier for administration to tumor cells.

A pharmaceutical formulation can also comprise a variant herpes simplex virus (HSV) having an intact endogenous Us12 encoding gene and an intact endogenous Us11 encoding gene, lacking functional ICP34.5 encoding genes, wherein each ICP34.5 encoding gene is replaced with a polynucleotide cassette comprising a nucleic acid sequence set forth in one of SEQ ID NO: 21, SEQ ID NO: 22, SEQ ID NO: 23, SEQ ID NO: 24 and SEQ ID NO: 25.

A pharmaceutical formulation can also comprise a variant herpes simplex virus (HSV) having a genome sequence set forth in SEQ ID NO: 26, SEQ ID NO: 27, SEQ ID NO: 28, SEQ ID NO: 29, or SEQ ID NO: 30.

Preferably, a pharmaceutical formulation provided herein is for administration to tumor cells in situ. In some embodiments, the pharmaceutical formulation comprises a variant HSV that selectively infects bladder cancer cells, human melanoma cells, human ovarian cancer cells, or human glioblastoma cells.

A method for killing tumor cells in a subject comprising: administering to a subject in need thereof a pharmaceutical formulation described above under conditions effective to kill tumor cells in the subject is also provided. Non-limiting examples of tumor cells that can be killed according to the methods described herein, include, e.g., astrocytoma, oligodendroglioma, meningioma, neurofibroma, glioblastoma, ependymoma, Schwannoma, neurofibrosarcoma, medulloblastoma, melanoma cells, pancreatic cancer cells, prostate carcinoma cells, breast cancer cells, lung cancer cells, colon cancer cells, hepatoma cells, mesothelioma, bladder cancer cells, and epidermoid carcinoma cells. In certain embodiments, the virus can selectively replicate in human bladder cancer cells or human melanoma cells. Administration to a subject can be carried out by injection, infusion, instillation or inhalation. In any of the above embodiments, a subject can be a mammal, such as a human.

In one embodiment, a method for treating cancer is also provided, wherein the method comprises administering to an individual in need of treatment, a therapeutically effective amount of a pharmaceutical formulation described above. In certain embodiments, the cancer is selected from the group consisting of bladder cancer, melanoma, ovarian cancer and glioblastoma.

The details of one or more embodiments of the invention are set forth in the accompanying drawings and the description below. Other features, objects, and advantages of the invention will be apparent from the description and drawings, and from the claims.

BRIEF DESCRIPTION OF DRAWINGS

FIGS. 1A-1C illustrate genetic properties of a wild-type HSV-1 (FIG. 1A) and of modified HSV-1 OncoVEX$^{GMCSF}$ where GM-CSF is under the control of the Cytomegalovirus (CMV) promoter (FIG. 1B) and OV-2711, expressing Us11 fused to an immediate early (IE) promoter. (FIG. 1C). Boxed regions designate inverted terminal repeat (TR) regions that flank the unique short ($U_s$) and unique long ($U_L$) components, represented by solid lines. Dotted lines indicate an expanded view of a region of the genome. The $U_s$-TRs junction region containing the Us11 and Us12 open reading frames (ORFs), designated by open rectangles, appears expanded. Stars represent the respective cis-acting promoter elements, where star-11 indicates the promoter for Us11 and star-12 indicates the promoter for Us12. The arrow above each box extending from the promoter element denotes the mRNA transcript that encodes each gene product. All of these mRNAs are polyadenylated at a common polyadenylation signal (not depicted) downstream from Us11. The Us12 mRNA is spliced, as indicated by the dip in the arrow joining two non-contiguous regions to form the mRNA.

FIG. 3A, at the top, shows the location of the gK gene within the α27-promoter, and the proposed, but currently uncharacterized, location of the gK promoter (indicated by a star and "?"). In FIG. 4, the diamond in the UL49.5-fs open reading frame (ORF) is a single C nucleotide insertion between the second and third codons of UL49.5 to create a frameshift (fs) mutation.

DETAILED DESCRIPTION

Overview

Figure 2:
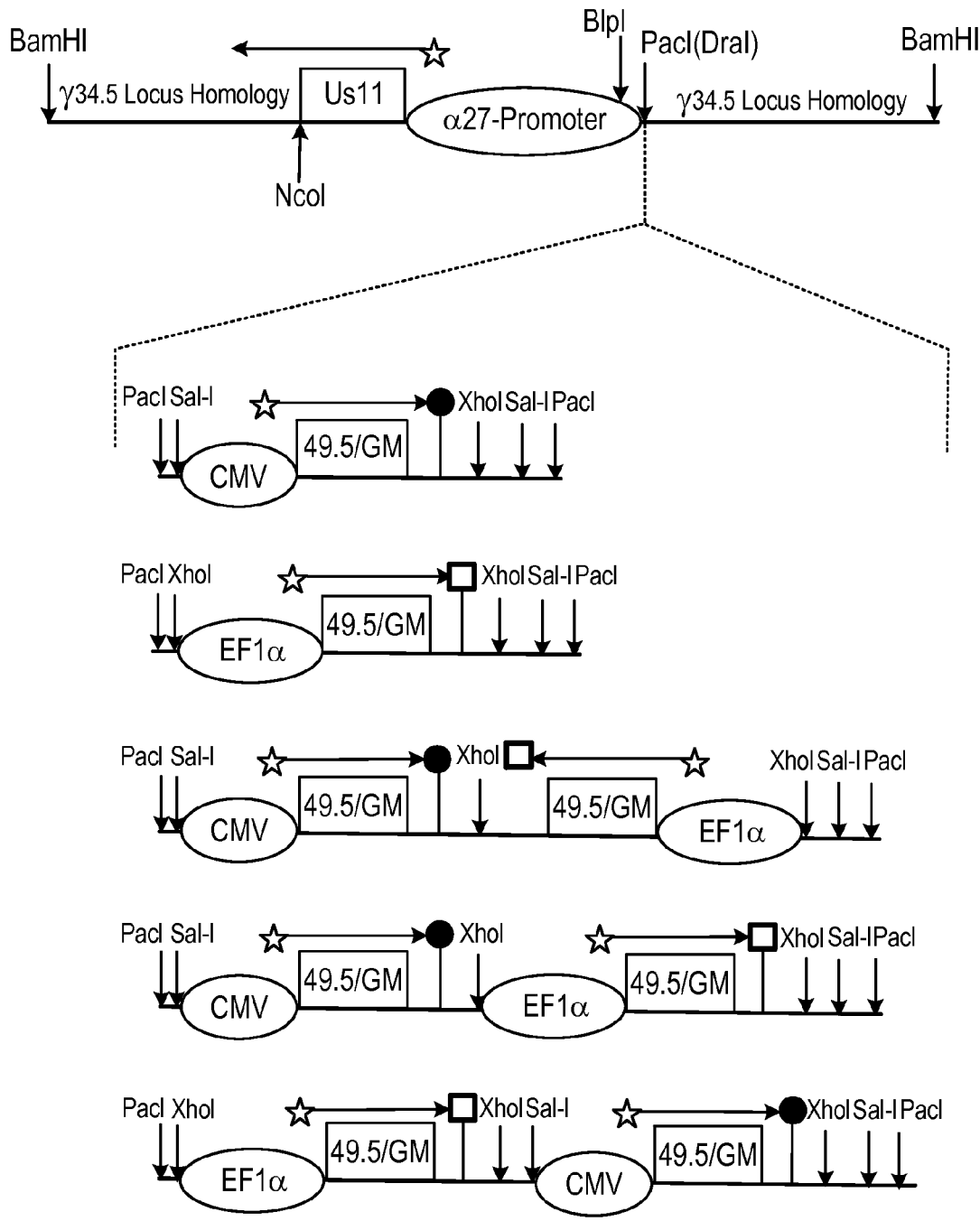
FIG. 2 illustrates the γ34.5 locus-targeting vector construction strategy.

The present invention provides novel variant herpes simplex viruses (HSV) with improved anti-tumor activity and improved ability to evade host immune responses. In particular, the variant HSV provided herein are non-neurovirulent, replicate in and destroy neoplastic cells, and have improved activity in syngeneic, immune-competent murine models, e.g., for human bladder and other types of cancers.

Thus, in a preferred embodiment, a variant HSV of the invention has an intact Us12 encoding gene and/or an intact endogenous Us11 encoding gene, and lacks functional ICP34.5 encoding genes, wherein each ICP34.5 encoding gene is replaced by a polynucleotide cassette comprising: (a) a Us11 encoding gene operably associated with an immediate early (IE) promoter; and (b) a gene encoding an inhibitor of antigen presentation on class I major histocompatibility (MHC) molecules (e.g., a TAP inhibitor) and/or a gene encoding a polypeptide capable of enhancing an anti-tumor response, such as GM-CSF, TNF-α, an interleukin (for example IL12), an interferon (such as IFN-γ) a chemokine such as RANTES or a macrophage inflammatory protein (MIP) (for example, MIP-3), or another immunomodulatory molecule such as B7.1 (CD80), B7.2 (CD86) or CD40L, to name a few. In one preferred embodiment, the polypeptide is a mammalian GM-CSF. The heterologous gene can also encode an enzyme that degrades or modifies extra-cellular matrix components in order to facilitate viral spread through the tumor, for example, a matrix metalloproteinase.

In another embodiment, a variant HSV of the invention has an intact Us12 encoding gene and/or an intact endogenous Us11 encoding gene, and lacks functional ICP34.5 encoding genes, wherein each ICP34.5 encoding gene is replaced by a polynucleotide cassette comprising at least one gene encoding a heterologous polypeptide. In a preferred embodiment, the variant HSV has an intact Us12 encoding gene and/or an intact endogenous Us11 encoding gene, and lacks functional ICP34.5 encoding genes, wherein each ICP34.5 encoding gene is replaced by a polynucleotide cassette comprising at least two genes encoding heterologous polypeptides. In certain embodiments, a heterologous polypeptide is selected from an inhibitor of antigen presentation on class I major histocompatibility (MHC) molecules (e.g., a TAP inhibitor), a polypeptide capable of enhancing an anti-tumor response (such as, but not limited to, GM-CSF, TNF-α, an interleukin (for example IL12), an interferon (such as IFN-γ) a chemokine (e.g., RANTES or a macrophage inflammatory protein (MIP) (e.g., MIP-3)), another immunomodulatory molecule (e.g., B7.1 (CD80), B7.2 (CD86), CD40L, etc.), and a prodrug converting enzyme. The heterologous gene can also encode an enzyme that degrades or modifies extra-cellular matrix components in order to facilitate viral spread through the tumor, for example, a matrix metalloproteinase.

In a particularly preferred embodiment, a variant HSV of the invention has an intact endogenous Us12 encoding gene and an intact endogenous Us11 encoding gene, and lacks functional ICP34.5 encoding genes, wherein each ICP34.5 encoding gene is replaced by a polynucleotide cassette comprising: a Us11 encoding gene operably associated with an immediate early (IE) promoter, a gene encoding a mammalian GM-CSF, and a gene encoding a TAP inhibitor.

Although the invention is not limited by any particular theory or mechanism of action, the ability of the virus to inhibit TAP, e.g., via ICP47, the gene product of Us12, increases its ability to evade host immune responses (e.g., cytolytic CD8 T cell responses), thereby improving the ability of the virus to spread throughout and kill tumor cells before being cleared by the host immune response. Furthermore, in certain embodiments, the variant HSV of the invention are particularly useful in animal models, e.g., rodent models of cancer, because they additionally comprise a gene encoding a TAP inhibitor active on murine TAP (e.g., UL49.5).

In certain embodiments, a variant HSV of the invention does not necessarily have an intact endogenous Us12 gene. It is preferable, however, if the variant HSV does not have an intact Us12 gene, that the variant HSV expresses a heterologous gene encoding a polypeptide having a substantially similar function (e.g., an immune evasion function, such as a TAP inhibitor or other inhibitor of antigen presentation on the virally infected cell surface by class I MHC molecules) as that encoded by the Us12 gene.

DEFINITIONS

The following definitions are provided for clarity and illustrative purposes only, and are not intended to limit the scope of the invention.

As used herein, the term "intact endogenous gene" in the context of a variant HSV of the invention refers to a gene (e.g., Us11 or Us12) that is a naturally occurring gene in its naturally occurring location in the HSV genome. Intact endogenous genes may be fused to a heterologous gene. For example, endogenous Us11 may be fused to GFP, but as long as Us11 is found in its naturally occurring location in the HSV genome, it is still an intact endogenous gene within the meaning of the term as used herein.

As used herein, the phrase "lacking functional ICP34.5 encoding genes" in the context of a variant HSV of the invention means that each of the two genes encoding ICP34.5 in the HSV genome have been partially or completely deleted, replaced, rearranged, or otherwise altered such that functional ICP34.5 polypeptide is not expressed by the HSV. Similarly, replacement of the ICP34.5 encoding gene (e.g., in the phrase "each ICP34.5 encoding gene is replaced") means that a heterologous sequence, e.g., in a gene expression cassette, is substituted for all or part of the ICP34.5 encoding gene ($\gamma_1$34.5), e.g., by homologous recombination, such that functional ICP34.5 cannot be expressed from that gene. The ICP34.5 encoding gene may be replaced with any suitable heterologous sequence. That heterologous sequence may subsequently be replaced with another heterologous sequence. For example, as described in Example 2, below, the ICP34.5 encoding gene was first replaced by Beta-glucoronidase to delete the ICP34.5 encoding gene, and then B-glucoronidase was replaced with IE-Us11.

The terms "polynucleotide cassette" and "gene expression cassette" means a manipulable fragment of DNA carrying, and capable of expressing, one or more genes of interest between one or more sets of restriction sites. It can be transferred from one DNA sequence (usually on a vector) to another by 'cutting' the fragment out using restriction enzymes and 'pasting' it back into the new context. Typically, the DNA fragment (nucleic acid sequence) is operatively associated with expression control sequence elements which provide for the proper transcription and translation of the target nucleic acid sequence(s) (genes). Such sequence elements may include a promoter and a polyadenylation signal. The "polynucleotide cassette" may further comprise "vector sequences." By "vector sequences" is meant any of several nucleic acid sequences established in the art which have utility in the recombinant DNA technologies of the invention to facilitate the cloning and propagation of the polynucleotide cassette including (but not limited to) plasmids, cosmids, bacterial artificial chromosomes, phage vectors, viral vectors, and yeast artificial chromosomes.

The term "heterologous" refers to a combination of elements not naturally occurring. Thus, for example, a "heterologous gene" refers to a gene to be introduced to the genome of a virus, wherein that gene is not normally found in the virus' genome or is a homolog of a gene expressed in the virus from a different species (e.g., the bovine herpes virus UL49.5 gene, which encodes for a TAP-inhibitor, is heterologous when inserted into the HSV genome, even though HSV also expresses a gene encoding a TAP-inhibitor (Us12), which has a different nucleic acid sequence and acts via a different biochemical mechanism.

Variant HSV of the invention infect and replicate in tumor cells, subsequently killing the tumor cells. Thus, such viruses are replication competent. Preferably, they are selectively replication competent, i.e., "selectively replicate" in tumor cells. This means that either they replicate in tumor cells and not in non-tumor cells, or that they replicate more effectively in tumor cells than in non-tumor cells. For example, where the variant HSV is used for treating a bladder tumor, the variant HSV is capable of replicating in the bladder tumor cells but not in the surrounding tissue. Cells in which the virus is able to replicate are permissive cells. Measurement of selective replication competence can be carried out by the tests described herein for measurement of replication and tumor cell-killing capacity, and also analyzed by the statistical techniques mentioned herein if desired.

The phrase "enhancing an anti-tumor response" in the context of a variant HSV mean that the "anti-tumor" response induced following infection with a variant HSV, as measured, for example, and without limitation, by decreased tumor growth, decreased tumor metastases, increased tumor cell death, increased CD8 T cell tumor infiltration, increased CD8 T cell-mediated tumor cell killing, increased levels of anti-tumor immune cells in the animal or human, and/or increased induction of anti-tumor immunity, is greater compared to the anti-tumor response in the control, e.g., in tumor cells following infection with, e.g., a Δ34.5 HSV lacking intact endogenous Us12 gene. By way of example, and without limitation, an anti-tumor response is enhanced by a variant HSV if the variant HSV increases tumor cell death by, e.g., at least 5-fold, at least 10-fold, at least 15-fold, at least 20-fold, at least 25-fold, at least 30-fold, at least 35-fold, at least 40-fold, at least 45-fold, at least 50-fold, at least 100-fold, at least 200-fold, at least 500-fold, at least 1000-fold or more, compared to the control.

As used herein, an "immunomodulatory polypeptide" in the context of a variant HSV of the invention refers to a polypeptide that is capable of altering the immune response to either the variant HSV or the host cell (i.e., the cell infected by the variant HSV), and/or to an uninfected host tumor cell. For example, one immunomodulatory polypeptide encompassed by the term is a TAP inhibitor polypeptide, such as, but not limited to, UL49.5 polypeptide from bovine herpes virus (BHV). While not intending to be bound by theory or by one particular mechanism of action, TAP inhibitor polypeptides are thought to prevent presentation of viral antigens on the host cell's MHC molecules, thereby preventing recognition of virally-infected cells by the host's immune system (e.g., by cytolytic CD8 T cells). Thus, TAP inhibitors downmodulate the host immune response's ability to identify and kill virally infected cells. Other immunomodulatory polypeptides, however, include immunostimulatory polypeptides, such as, but not limited to, GM-CSF, TNF-α and CD40L. Those exemplary polypeptides recruit and/or activate immune cells to infiltrate tumors, process immunoactive molecules, recognize tumor cells and/or lyse tumor cells (e.g., help mediate the oncolytic function of the variant HSV of the invention), and, therefore, upmodulate the host immune response. Importantly, in certain embodiments, the presence of immunostimulatory polypeptides, e.g., GM-CSF, which can enhance immune recruitment to virally infected cells and tumors, has the potential to be deleterious to viral infection of tumor cells and viral spread throughout tumor cells. Thus, it is particularly preferred that the variant HSV of the invention additionally comprise a heterologous polypeptide that is capable of enhancing the immune evasion capabilities, and therefore the replication and spread, of the variant HSV, such as, but not limited to polypeptides that inhibit viral antigen presentation by infected cells (e.g., UL49.5 from BHV).

The terms "express" and "expression" mean allowing or causing the information in a gene or DNA sequence to become manifest, for example producing a polypeptide encoded by the gene or DNA sequence. As used herein, a gene or DNA sequence is expressed in or by a virus to form an "expression product" such as a polypeptide. The expression product itself, e.g., the resulting polypeptide, may also be said to be "expressed" by the virus.

The term "gene", also called a "structural gene" means a DNA sequence that codes for or corresponds to a particular sequence of amino acids which comprise all or part of one or more polypeptides (e.g., proteins), and may or may not include regulatory DNA sequences, such as promoter sequences, which determine for example the conditions under which the gene is expressed. Some genes, which are not structural genes, may be transcribed from DNA to RNA, but are not translated into an amino acid sequence. Other genes may function as regulators of structural genes or as regulators of DNA transcription.

A coding sequence is "under the control of" or "operatively associated with" expression control sequences in a virus or cell when RNA polymerase transcribes the coding sequence into RNA, particularly mRNA, which is then spliced (if it contains introns) and translated into the polypeptide encoded by the coding sequence.

The term "expression control sequence" refers to a promoter and any enhancer or suppression elements that combine to regulate the transcription of a coding sequence. In a preferred embodiment, the element is a transcriptional promoter.

A sequence "encoding" an expression product, such as a polypeptide, is a minimum nucleotide sequence that, when expressed, results in the production of that polypeptide.

The term "host cell" means any cell of any organism that is selected, modified, transformed, grown, infected or used or manipulated in any way for the production of a substance by the cell or to grow, test, screen, or carry out another desired activity on, a variant HSV of the invention. For example, a host cell may be one that is manipulated to express a particular gene, a DNA or RNA sequence, a polypeptide. In a preferred embodiment, a host cell is any one which is capable of being infected with a variant HSV (or control HSV) of the invention, e.g., for screening or other assays that are described infra, e.g., for screening the activity, replication and protein synthesis efficiency of variant HSV of the invention. Such suitable cells are well known in the art. Host cells may be cultured in vitro or one or more cells in a non-human animal (e.g., a transgenic animal or a transiently transfected animal). Exemplary suitable host cells include, but are not limited to, UMUC3, T24, J82 and EJ (MGH-U1), J82 (CO'T), RT4, RT112, TCCSuP and SCaBER cells.

"Treating" or "treatment" of a state, disorder or condition includes: (1) preventing or delaying the appearance of clinical or sub-clinical symptoms of the state, disorder or condition developing in a mammal that may be afflicted with or predisposed to the state, disorder or condition but does not yet experience or display clinical or subclinical symptoms of the state, disorder or condition; or (2) inhibiting the state, disorder or condition, i.e., arresting, reducing or delaying the development of the disease or a relapse thereof (in case of maintenance treatment) or at least one clinical or sub-clinical symptom thereof; or (3) relieving the disease, i.e., causing regression of the state, disorder or condition or at least one of its clinical or sub-clinical symptoms.

For example, in relation to cancer, the term "treat" may mean to relieve or alleviate at least one symptom selected from the group consisting of tumor growth, metastasis, sensitivity of tumor cells to treatments such as chemotherapy, radiation therapy, thermotherapy, etc. The term "treat" also denotes to arrest, delay the onset (i.e., the period prior to clinical manifestation of a disease) and/or reduce the risk of developing or worsening a disease. In a specific embodiment, treating cancer comprises killing a tumor cell, e.g., with an oncolytic virus of the invention.

The benefit to a subject to be treated is either statistically significant or at least perceptible to the patient or to the physician.

"Patient" or "subject" refers to mammals, for example and without limitation, rodents (e.g., mice and rats), dogs, cats, cows, sheep, primates, and includes human and veterinary subjects.

An "effective amount" of a compound of the present invention includes doses that partially or completely achieve the desired therapeutic, prophylactic, and/or biological effect. The actual amount effective for a particular application depends on the condition being treated and the route of administration. The effective amount for use in humans can be determined from animal models.

As used herein the term "therapeutically effective" applied to dose or amount refers to that quantity of a compound or composition (e.g., pharmaceutical composition) that is sufficient to result in a desired activity upon administration to an animal in need thereof. Thus, within the context of the present invention, the term "therapeutically effective amount" refers to that quantity of a compound or composition that is sufficient to treat at least one symptom of a cancer, such as but not limited to cancer cell proliferation, tumor growth, resistance to apoptosis, and angiogenesis, and/or to inhibit metastasis of a cancer cell. When a combination of active ingredients is administered, an effective amount of the combination may or may not include amounts of each ingredient that would have been effective if administered individually. A "prophylactically effective amount" is an amount of a pharmaceutical composition that, when administered to a subject, will have the intended prophylactic effect, e.g., preventing or delaying the onset (or recurrence) of cancer, or reducing the likelihood of the onset (or recurrence) of cancer or cancer symptoms. The full prophylactic effect does not necessarily occur by administration of one dose, and may occur only after administration of a series of doses. Thus, a prophylactically effective amount may be administered in one or more administrations.

The term "about" or "approximately" means within an acceptable range for the particular value as determined by one of ordinary skill in the art, which will depend in part on how the value is measured or determined, e.g., the limitations of the measurement system. For example, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5 fold, and more preferably within 2 fold, of a value. Unless otherwise stated, the term 'about' means within an acceptable error range for the particular value, such as ±1-20%, preferably ±1-10% and more preferably ±1-5%.

As used herein, the terms "mutant" and "mutation" refer to any detectable change in genetic material (e.g., DNA) or any process, mechanism, or result of such a change. This includes gene mutations, in which the structure (e.g., DNA sequence) of a gene is altered, any gene or DNA arising from any mutation process, and any expression product (e.g., polypeptide) expressed by a modified gene or DNA sequence. As used herein, the term "mutating" refers to a process of creating a mutant or mutation.

The term "nucleic acid hybridization" refers to antiparallel hydrogen bonding between two single-stranded nucleic acids, in which A pairs with T (or U if an RNA nucleic acid) and C pairs with G. Nucleic acid molecules are "hybridizable" to each other when at least one strand of one nucleic acid molecule can form hydrogen bonds with the complementary bases of another nucleic acid molecule under defined stringency conditions. Stringency of hybridization is determined, e.g., by (i) the temperature at which hybridization and/or washing is performed, and (ii) the ionic strength and (iii) concentration of denaturants such as formamide of the hybridization and washing solutions, as well as other parameters. Hybridization requires that the two strands contain substantially complementary sequences. Depending on the stringency of hybridization, however, some degree of mismatches may be tolerated. Under "low stringency" conditions, a greater percentage of mismatches are tolerable (i.e., will not prevent formation of an antiparallel hybrid). See Molecular Biology of the Cell, Alberts et al., 3rd ed., New York and London: Garland Publ., 1994, Ch. 7.

Typically, hybridization of two strands at high stringency requires that the sequences exhibit a high degree of complementarity over an extended portion of their length. Examples of high stringency conditions include: hybridization to filter-bound DNA in 0.5 M NaHPO4, 7% SDS, 1 mM EDTA at 65° C., followed by washing in 0.1×SSC/0.1% SDS at 68° C. (where 1×SSC is 0.15M NaCl, 0.15M Na citrate) or for oligonucleotide molecules washing in 6×SSC/ 0.5% sodium pyrophosphate at about 37° C. (for 14 nucleotide-long oligos), at about 48° C. (for about 17 nucleotide-long oligos), at about 55° C. (for 20 nucleotide-long oligos), and at about 60° C. (for 23 nucleotide-long oligos)). Accordingly, the term "high stringency hybridization" refers to a combination of solvent and temperature where two strands will pair to form a "hybrid" helix only if their nucleotide sequences are almost perfectly complementary (see Molecular Biology of the Cell, Alberts et al., 3rd ed., New York and London: Garland Publ., 1994, Ch. 7).

Conditions of intermediate or moderate stringency (such as, for example, an aqueous solution of 2×SSC at 65° C.; alternatively, for example, hybridization to filter-bound DNA in 0.5 M NaHPO4, 7% SDS, 1 mM EDTA at 65° C., and washing in 0.2×SSC/0.1% SDS at 42° C.) and low stringency (such as, for example, an aqueous solution of 2×SSC at 55° C.), require correspondingly less overall complementarity for hybridization to occur between two sequences. Specific temperature and salt conditions for any given stringency hybridization reaction depend on the concentration of the target DNA and length and base composition of the probe, and are normally determined empirically in preliminary experiments, which are routine (see Southern, J. Mol. Biol. 1975; 98: 503; Sambrook et al., Molecular Cloning: A Laboratory Manual, 2nd ed., vol. 2, ch. 9.50, CSH Laboratory Press, 1989; Ausubel et al. (eds.), 1989, Current Protocols in Molecular Biology, Vol. I, Green Publishing Associates, Inc., and John Wiley & Sons, Inc., New York, at p. 2.10.3).

As used herein, the term "standard hybridization conditions" refers to hybridization conditions that allow hybridization of sequences having at least 75% sequence identity. According to a specific embodiment, hybridization conditions of higher stringency may be used to allow hybridization of only sequences having at least 80% sequence identity, at least 90% sequence identity, at least 95% sequence identity, or at least 99% sequence identity.

Nucleic acid molecules that "hybridize" to any desired nucleic acids of the present invention may be of any length. In one embodiment, such nucleic acid molecules are at least 10, at least 15, at least 20, at least 30, at least 40, at least 50, and at least 70 nucleotides in length. In another embodiment, nucleic acid molecules that hybridize are of about the same length as the particular desired nucleic acid.

A "nucleic acid molecule" refers to the phosphate ester polymeric form of ribonucleosides (adenosine, guanosine, uridine or cytidine; "RNA molecules") or deoxyribonucleosides (deoxyadenosine, deoxyguanosine, deoxythymidine, or deoxycytidine; "DNA molecules"), or any phosphoester analogs thereof, such as phosphorothioates and thioesters, in either single stranded form, or a double-stranded helix. Double stranded DNA-DNA, DNA-RNA and RNA-RNA helices are possible. The term nucleic acid molecule, and in particular DNA or RNA molecule, refers only to the primary and secondary structure of the molecule, and does not limit it to any particular tertiary forms. Thus, this term includes double-stranded DNA found, inter alia, in linear (e.g., restriction fragments) or circular DNA molecules, plasmids, and chromosomes. In discussing the structure of particular double-stranded DNA molecules, sequences may be described herein according to the normal convention of giving only the sequence in the 5' to 3' direction along the non-transcribed strand of DNA (i.e., the strand having a sequence homologous to the mRNA). A "recombinant DNA molecule" is a DNA molecule that has undergone a molecular biological manipulation.

As used herein, the term "homologs" refers to genes in different species that apparently evolved from a common ancestral gene by speciation. Normally, homologs retain the same function through the course of evolution. Identification of homologs can provide reliable prediction of gene function in newly sequenced genomes. Sequence comparison algorithms that can be used to identify homologs include without limitation BLAST, FASTA, DNA Strider, and the GCG pileup program. Homologs often have high sequence similarity. The present invention encompasses all homologs of the desired polypeptide.

The terms "percent (%) sequence similarity", "percent (%) sequence identity", and the like, generally refer to the degree of identity or correspondence between different nucleotide sequences of nucleic acid molecules or amino acid sequences of polypeptides that may or may not share a common evolutionary origin (see Reeck et al., supra). Sequence identity can be determined using any of a number of publicly available sequence comparison algorithms, such as BLAST, FASTA, DNA Strider, GCG (Genetics Computer Group, Program Manual for the GCG Package, Version 7, Madison, Wis.), etc.

To determine the percent identity between two amino acid sequences or two nucleic acid molecules, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are, or are about, of the same length. The percent identity between two sequences can be determined using techniques similar to those described below, with or without allowing gaps. In calculating percent sequence identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, Proc. Natl. Acad. Sci. USA 1990, 87:2264, modified as in Karlin and Altschul, Proc. Natl. Acad. Sci. USA 1993, 90:5873-5877. Such an algorithm is incorporated into the NBLAST and XBLAST programs of Altschul et al., J. Mol. Biol. 1990; 215: 403. BLAST nucleotide searches can be performed with the NBLAST program, score=100, wordlength=12, to obtain nucleotide sequences homologous to sequences of the invention. BLAST protein searches can be performed with the XBLAST program, score=50, wordlength=3, to obtain amino acid sequences homologous to protein sequences of the invention. To obtain gapped alignments for comparison purposes, Gapped BLAST can be utilized as described in Altschul et al., Nucleic Acids Res. 1997, 25:3389. Alternatively, PSI-Blast can be used to perform an iterated search that detects distant relationship between molecules. See Altschul et al. (1997) supra. When utilizing BLAST, Gapped BLAST, and PSI-Blast programs, the default parameters of the respective programs (e.g., XBLAST and NBLAST) can be used. See ncbi.nlm.nih.gov/BLAST/ on the WorldWideWeb. Another non-limiting example of a mathematical algorithm utilized for the comparison of sequences is the algorithm of Myers and Miller, CABIOS 1988; 4: 11-17. Such an algorithm is incorporated into the ALIGN program (version 2.0), which is part of the GCG sequence alignment software package. When utilizing the ALIGN program for comparing amino acid sequences, a PAM120 weight residue table, a gap length penalty of 12, and a gap penalty of 4 can be used.

In a preferred embodiment, the percent identity between two amino acid sequences is determined using the algorithm of Needleman and Wunsch (J. Mol. Biol. 1970, 48:444-453), which has been incorporated into the GAP program in the GCG software package (Accelrys, Burlington, Mass.; available at accelrys.com on the WorldWideWeb), using either a Blossum 62 matrix or a PAM250 matrix, a gap weight of 16, 14, 12, 10, 8, 6, or 4, and a length weight of 1, 2, 3, 4, 5, or 6. In yet another preferred embodiment, the percent identity between two nucleotide sequences is determined using the GAP program in the GCG software package using a NWS-gapdna.CMP matrix, a gap weight of 40, 50, 60, 70, or 80, and a length weight of 1, 2, 3, 4, 5, or 6. A particularly preferred set of parameters (and the one that can be used if the practitioner is uncertain about what parameters should be applied to determine if a molecule is a sequence identity or homology limitation of the invention) is using a Blossum 62 scoring matrix with a gap open penalty of 12, a gap extend penalty of 4, and a frameshift gap penalty of 5.

Statistical analysis of the properties described herein may be carried out by standard tests, for example, t-tests, ANOVA, or Chi squared tests. Typically, statistical significance will be measured to a level of p=0.05 (5%), more preferably p=0.01, p=0.001, p=0.0001, p=0.000001.

Structure of Herpes Simplex Viruses and Variants

The variant HSV of the invention may be derived from a herpes simplex virus (HSV) strain. The HSV strain may be an HSV-1 or HSV-2 strain, or a derivative thereof, and is preferably HSV-1. For example, a variant HSV of the invention may be derived from a wild-type HSV-1, strain 17, having GenBank Accession No. X14112 and the nucleic acid sequence set forth in SEQ ID NO: 1 in the sequence listing.

HSV strains of the invention may be "laboratory" or "non-laboratory" ("clinical") strains. Laboratory strains in current use include HSV-1 strain F, HSV-1 strain 17, HSV-1 strain KOS, and strain Patton. Clinical strains useful in the invention typically have improved oncolytic activity compared to HSV-1 strains F, 17+ and KOS strains with equivalent modifications.

While the sequence for the complete genome of strain 17 of HSV-1 is provided herein as an example, the nucleic acid sequence of any suitable lab strain (e.g., F, KOS, and Patton) and/or clinical isolate can be used according to the present invention. Derivatives of HSV, which may also be used according to the invention described herein, include but are not limited to inter-type recombinants containing DNA from HSV-1 and HSV-2 strains. Such inter-type recombinants are described in the art, for example in Thompson et al., "DNA sequence and RNA transcription through a site of recombination in a non-neurovirulent herpes simplex virus intertypic recombinant," Virus Genes, 1(3): 275-286, 1998; and Meignier et al., "In vivo behaviour of genetically engineered herpes simplex viruses R7017 and R7020: construction and evaluation in rodents," J. Infect. Dis., 158(3): 602-614, 1988. Derivatives preferably have at least 70% sequence homology to either the HSV-1 or HSV-2 genome, more preferably at least 80%, even more preferably at least 90 or 95%. More preferably, a derivative has at least 70% sequence identity to either the HSV-1 or HSV-2 genome, more preferably at least 80% identity, even more preferably at least 90%, 95% or 98% identity.

HSV-1 is a double-stranded DNA virus, having a genome size of 152 kb, which is replicated and transcribed in the nucleus of a host cell. HSV-1 has two unique genome segments: Unique-long ($U_L$) and Unique-short ($U_s$). As shown in FIG. 1A, both unique sequences are flanked by inverted terminal repeats. In wild-type HSV-1, the $\gamma_1 34.5$ gene, which encodes ICP34.5 polypeptide and confers neurovirulence [see, Chou J, et al. "Mapping of herpes simplex virus-1 neurovirulence to gamma 1 34.5, a gene nonessential for growth in culture." Science 1990; 250:1262-6], is a diploid element located within the inverted repeats flanking $U_L$. The Us12 gene, located in the $U_s$ segment, is expressed very early during infection by an immediate early promoter. The Us11 gene, a $\gamma_2$ gene, is expressed late in viral infection by a separate promoter contained within the Us12 gene.

In the HSV-1 strain 17 genome (GenBank Accession No. X14112) (SEQ ID NO: 1), the ORF for Us11 is found at nucleotides 144761-145246, and has the following sequence:

(SEQ ID NO: 2)
ctatacagacccgcgagccgtacgtggttcgcgggggggtgcgtggggtcc ggggctcccggggagaccggggctcccggggagaccggggctccctggga gaccggggttgtcgtggatccctggggtcacgcggtaccctggggtctct gggagctcgcggtactctgggttccctaggttctcggggtggtcgcggaa cccggggctcccggggaacacgcggtgtcctggggattgttggcggtcgg acggcttcagatggcttcgagatcgtagtgtccgcaccgactcgtagtag acccgaatctccacattgccccgccgcttgatcattatcaccccgttgcg ggggtccggagatcatgcgcgggtgtcctcgaggtgcgtgaacacctctg gggtgcatgccggcggacggcacgccttttaagtaaacatctgggtcgcc cggcccaactggggccgggggttgggtctggctcat.

In the HSV-1 strain 17 genome (GenBank Accession No. X14112) (SEQ ID NO: 1), the ORF for Us12 is found at nucleotides 145311-145577, and has the following sequence:

(SEQ ID NO: 3)
tcaacgggttaccggattacggggactgtcggtcacggtcccgccggttc ttcgatgtgccacacccaaggatgcgttgggggcgatttcgggcagcagc ccgggagagcgcagcaggggacgctccgggtcgtgcacggcggttctggc cgcctcccggtcctcacgcccccttttattgatctcatcgcgtacgtcgg cgtacgtcctgggcccaacccgcatggtgtccaggaaggtgtccgccatt tccagggcccacgacat.

Exemplary sequences of certain genes encoded in the HSV-1 genome as well an exemplary sequence of an entire HSV-1 genome are provided herein. However, it is to be understood that the present invention is not limited to the exemplary sequences provided herein, and the invention includes variants of those sequences that encode the same gene(s), as well as nucleic acid (gene) sequences encoding functional homologs (i.e., a polypeptide having substantially the same activity, but encoded by a different gene.

Multiple herpes simplex virus type 1 functions control translation by regulating phosphorylation of the initiation factor eIF2 on its alpha subunit. Both of the two known regulators, the $\gamma_1 34.5$-encoded and Us11 gene products, are produced late in the viral life cycle, although the $\gamma_1 34.5$ gene is expressed prior to the $\gamma_2$ Us11 gene, as $\gamma_2$ genes require viral DNA replication for their expression while $\gamma_1$ genes do not. The ICP34.5 polypeptide, the product of the $\gamma_1 34.5$ gene, through a GADD34-related domain, binds a cellular phosphatase (PP1α), maintaining pools of active, unphosphorylated eIF2. Infection of a variety of cultured cells with an ICP34.5 mutant virus results in the accumulation of phosphorylated eIF2α and the inhibition of translation prior to the completion of the viral lytic program. Ectopic, immediate-early Us11 expression prevents eIF2α phosphorylation and the inhibition of translation observed in cells infected with a ICP34.5 mutant by inhibiting activation of the cellular kinase PKR and the subsequent phosphorylation of eIF2α. Further, the Us11 polypeptide is critical for proper late translation rates. The shutoff of protein synthesis observed in cells infected with an ICP34.5 mutant virus results from the combined loss of ICP34.5 and Us11 functions, as the Us11 mRNA is not translated in cells infected with an ICP34.5 mutant.

Viral regions altered for the purposes described above may be either eliminated (completely or partly), or made non-functional, or substituted by other sequences, for example, and without limitation, by a gene encoding a prodrug converting enzyme, a gene encoding a polypeptide capable of causing cell to cell fusion, a gene encoding an immunomodulatory polypeptide, or a gene encoding a function that modifies the extracellular matrix.

A derivative may have the sequence of a HSV-1 or HSV-2 genome modified by nucleotide substitutions, for example from 1, 2 or 3 to 10, 25, 50 or 100 substitutions. The HSV-1 or HSV-2 genome may alternatively or additionally be modified by one or more insertions and/or deletions and/or by an extension at either or both ends.

The properties of the variant HSV with respect to tumor cells can be measured in any manner known in the art. For example, the capacity of a variant HSV to infect a tumor cell can be quantified by measuring the variant HSV's capacity to replicate in a tumor cell, as measured by growth measurements, e.g., by measuring virus growth (viral titer) in cells over a period of 6, 12, 24, 36, 48 or 72 hours or longer. As described in the Examples, below, the ability of a variant HSV to infect and replicate within a tumor cell can be measured by determining the percentage of cells exhibiting a cytopathic effect (cpe) following infection with the variant HSV, wherein a variant HSV having the ability to infect cells will induce a cpe in at least about 50%, 60%, 70%, 80% or preferably 90% of the cells. The ability of a variant HSV to infect and replicate within a tumor cell may also be measured indirectly by measuring production of viral polypeptides (e.g., by $^{35}$S cysteine and methionine labeling followed by SDS-PAGE and autoradiography and Western blot analysis).

The ability of a virus to kill tumor cells can be roughly quantitated by eye or more exactly quantitated by counting the number of live cells that remain over time for a given time point and multiplicity of infection (MOI) for given cell type. For example, comparisons may be made over 24, 48 or 72 hours and using any known tumor cell type. In particular, UMUC3 invasive, high-grade bladder cancer, HT29 colorectal adenocarcinoma, LNCaP.FGC prostate adenocarcinoma, MDA-MB-231 breast adenocarcinoma, SK-MEL-28 malignant melanoma or U-87 MG glioblastoma astrocytoma cells can be used. Other examples of cell lines that are well known in the art and which may be used include, but are not limited to, HTB-161, SW620, A2780S, COLO205, A2780DDP, CX-1, SW948, SKBR3, MCF-7, HCT-15, CACO-2, A549, NEC, LX-1, T47D, B7474, DU145, PC3, SK-MEL-303, and LN-CAP cell lines. Any one of these cell types or any combination of these cell types can be used, as may other tumor cell types. It may be desirable to construct a standard panel of tumor cell types for this purpose. To count the number of live cells remaining at a given time point, the number of trypan blue-excluding cells (i.e., live cells) can be counted. Quantitation may also be carried out by fluorescence activated cell sorting (FACS) or MTT assay. Tumor cell-killing ability may also be measured in vivo, e.g., by measuring the reduction in tumor volume engendered by a particular virus, as described, e.g., in the Examples, below.

In order to determine the properties of variant HSV of the invention, it will generally be desirable to use a standard laboratory reference strain for comparison. Any suitable standard laboratory reference strain may be used. In the case of HSV, it is preferred to use one or more of HSV-1 strain 17+, HSV-1 strain F, HSV-1 strain KOS, or HSV-1 strain Patton. The reference strain will typically have equivalent modifications to the strain of the invention being tested. Thus, the reference strain will typically have equivalent modifications, such as gene deletions and heterologous gene insertions. In the case of a variant HSV of the invention, where the ICP34.5 encoding genes have been replaced or otherwise rendered non-functional, the ICP34.5 encoding genes will also have been rendered non-functional in the reference strain. The modifications made to the reference strain may be identical to those made to the strain of the invention. By this, it is meant that the gene disruptions in the reference strain will be in exactly equivalent positions to those in the strain of the invention, e.g., deletions will be of the same size and in the same place. Similarly, in these embodiments, heterologous genes will be inserted in the same place, driven by the same promoter, etc. However, it is not essential that identical modifications be made. What is important is that the reference strain has functionally equivalent modifications, e.g., that the same genes are rendered non-functional and/or the same heterologous gene or genes is inserted.

Replacement of ICP34.5 Encoding Genes

The variant HSV of the invention have intact endogenous Us11 and Us12 genes and the ICP34.5 encoding genes are replaced with a polynucleotide cassette comprising a Us11 gene operatively associated with an immediate early (IE) promoter ("IE-Us11"). Preferably, the polynucleotide cassette additionally comprises one or more genes encoding a heterologous polypeptide, as described herein.

By way of example, in the HSV-1 strain 17 genome (GenBank Accession No. X14112) (SEQ ID NO: 1), the ORF for the first ICP34.5 encoding ($\gamma_1$34.5) gene is found at nucleotides 513-1259, and has the following sequence:

```
                                        (SEQ ID NO: 4)
atggcccgccgccgccgccatcgcggcccccgccgccccggccgccgg gccacgggcgccgtcccaaccgcacagtcccaggtaacctccacgccca actcggaacccgcggtcaggagcgcgcccgcggccgccccgccgccgccc cccgccggtgggcccccgccttcttgttcgctgctgctgcgccagtggct ccacgttcccgagtccgcgtccgacgacgacgatgacgacgactggccgg acagcccccgcccgagccggcgccagaggcccggcccaccgccgccgcc ccccggccccggcccccaccgcccggcgtgggcccgggggcggggctga cccctcccacccccctcgcgcccttccgccttccgccgcgcctcgccc tccgcctgcgcgtcaccgcggagcacctggcgcgcctgcgcctgcgacgc gcgggcggggaggggcgccggagcccccgcgaccccgcgaccccgc gaccccgcgaccccgcgaccccgcgcgggtgcgcttctcgccccacg tccgggtgcgccacctggtggtctgggcctcggccgcccgcctggcgcgc cgcggctcgtgggcccgcgagcgggccgaccgggctcggttccggcgccg ggtggcggaggccgaggcggtcatcgggccgtgcctggggcccgaggccc gtgcccgggccctggcccgcggagccggcccggcgaactcggtctaa.
```

Further, the ORF for the second ICP34.5 encoding ($\gamma_1$34.5) gene is found at nucleotides 125112-125858, and has the following sequence:

(SEQ ID NO: 5)
```
ttagaccgagttcgccgggccggctccgcgggccagggcccgggcacggg cctcgggccccaggcacggcccgatgaccgcctcggcctccgccacccgg cgccggaaccgagcccggtcggcccgctcgcgggcccacgagccgcggcg cgccaggcgggcggccgaggcccagaccaccaggtggcgcacccggacgt ggggcgagaagcgcacccgcgcgggggtcgcgggggtcgcgggggtcgcg ggggtcgcgggggtcgcgggggggctccggcgcccctcccgcccgcgcg tcgcaggcgcaggcgcgccaggtgctccgcggtgacgcgcaggcggaggg cgaggcgcggcggaaggcggaaggggcgcgaggggggggtgggaggggtca gccccgcccccgggcccacgccgggcggtgggggccggggccggggggc ggcggcggtgggccgggcctctggcgccggctcgggcggggggctgtccg gccagtcgtcgtcatcgtcgtcgtcggacgcggactcgggaacgtggagc cactggcgcagcagcagcgaacaagaaggcgggggcccaccggcgggggg cggcggcggggcggccgcgggcgcgctcctgaccgcgggttccgagttgg gcgtggaggttacctgggactgtgcggttgggacggcgcccgtgggcccg ggcggccggggcggcggggccgcgatggcggcggcggcgggccat.
```

ICP34.5 encoding genes ($\gamma_1$34.5 genes) may be rendered functionally inactive (e.g., replaced) by several techniques well known in the art. For example, they may be rendered functionally inactive by deletion(s), substitution(s) or insertion(s), preferably by deletion. Deletions may remove one or more portions of the gene or the entire gene. For example, deletion of only one nucleotide may be made, resulting in a frame shift. However, preferably a larger deletion(s) is made, for example at least 25%, more preferably at least 50% of the total coding and non-coding sequence (or alternatively, in absolute terms, at least 10 nucleotides, more preferably at least 100 nucleotides, most preferably, at least 1000 nucleotides). It is particularly preferred to remove the entire gene and some of the flanking sequences, e.g., by replacing the gene by inserting (e.g., via homologous recombination) one or more expression cassettes comprising heterologous gene(s) into the $\gamma_1$34.5 locus. Where two or more copies of the gene are present in the viral genome it is preferred that both copies of the gene are rendered functionally inactive. HSV have two copies of ICP34.5 encoding ($\gamma_1$34.5) genes, and thus, it is particularly preferred that both copies of the ICP34.5 encoding genes are replaced and/or rendered functionally inactive.

In a preferred embodiment, both ICP34.5 encoding ($\gamma_1$34.5) genes of HSV are replaced with gene expression cassettes each comprising an IE-Us11 gene and one or more heterologous polypeptides described herein. However, it is also possible that only one of the $\gamma_1$34.5 genes is replaced with one or more gene expression cassettes comprising an IE-Us11 gene and one or more heterologous polypeptides, and the other $\gamma_1$34.5 gene is deleted or otherwise rendered functionally inactive without inserting an expression cassette, or by inserting a different gene expression cassette or combination of gene expression cassettes.

Non-limiting examples of the IE promoter operably linked to the Us11 gene include α0, α4, α22, α27 and α47. In a preferred embodiment, the IE promoter is α27. By way of example, the nucleic acid sequences encoding the α0, α4, α22, α27 and α47 promoters in the HSV-1 strain 17 genome (GenBank Accession No. X14112) (SEQ ID NO: 1) are provided below:

The α0 promoter gene is diploid and found at nucleotides 1302-2166 and 125069-124205, and has the following sequence:

(SEQ ID NO: 6)
```
gagctccgcaccaagccgctctccggagagacgatggcaggagccgcgca tatatacgcttggagccagcccgccctcacagggcgggccgcctcggggg cgggactggccaatcggcggccgccagcgcggcggggcccggccaaccag cgtccgccgagtcttcggggcccggcccattgggcgggagttaccgccca atgggccgggccgcccacttcccggtatggtaattaaaaacttgcaagag gccttgttccgcttcccggtatggtaattagaaactcattaatgggcggc cccggccgcccttcccgcttccggcaattcccgcggcccttaatgggcaa ccccggtattcccgcctcccgccgcgcgtaaccactcccctggggtt ccgggttatgctaattgcttattggcggaacacacggcccctcgcgcatt ggccgcgggtcgctcaatgaacccgcattggtccctggggttccgggt atggtaatgagtttcttcgggaaggcgggaagccccggggcaccgacgca ggccaagccctgttgcgtcggcgggaggggcatgctaatgggttattg ggggacaccgggttgggcccccaaatcggggcgggccgtgcatgctaa tgatattctttgggggcgccgggttggtccccggggacggggccgccccg cggtgggcctgcctcccctgggacgcgcggccattggggaatcgtcact gccgccctttggggaggggaaaggcgtggggtataagttagccctggcc cgacagtctggtcgcatttgcacctcggcactcggagcgagacgcagcag ccaggcagactcg.
```

There are two α4 promoter genes composed of a shared portion of the terminal repeat short and either the unique short sequence containing the α22 ORF or the ICP47 ORF: The α4 promoter gene with the unique short sequence containing the α22 ORF is found at nucleotides 131399-136294, and has the following sequence:

(SEQ ID NO: 7)
```
ggatccgtgtcggcagccgcgctccgtgtggacgatcgggcgtcctcgggctcatatagtcccaggggccggcgggaaggaggagcagcggaggccgcc ggccccccgccccccggcgggcccacccgaacggaattccattatgcacgacccgccccgacgccggcacgccgggggcccgtggccgcggcccgtt ggtcgaaccccggccccgcccatccgcgccatctgccatgggcggggcgcgaggcgggtgggtccgcgccccgccccgcatggcatctcattaccgcc cgatccggcggtttccgcttccgttccgcatgctaacgaggaacgggcaggggcggggcccgggcccgacttcccggttcggcggtaatgagatacga gccccgcgcgcccgttggccgtcccgggcccccaggtccgccgccggacgccgggaccaacgggacggcgggcgccaagggccgcccgccttgcc
```

-continued

```
gcccccccattggccggcgggcgggaccgccccaaggggcggggccgccggtaaaagaagtgagaacgcgaagcgttcgcacttcgtcccaatatata tatattattagggcgaagtgcgagcactggcgccgtgcccgactccgcgccggccccggggggcgggcccgggcggcggggggcgggtctctccggcgcac ataaaggcccggcgcgaccgacgcccgcagacggcgccggccacgaacgacgggagcggctgcggagcacgcggaccgggagcggagtcgcagagggcc gtcggagcggacggcgtcggcatcgcgacgccccggctcgggatcgggatcgcatcggaaagggacacgcggacgcgggggggaaagacccgcccacccc acccacgaaacacaggggacgcaccccgggggcctccgacgacagaaacccaccggtccgccttttttgcacgggtaagcaccttgggtgggcggaggag gggggacgcggggcggaggagggggacgcggggcggaggagggggacgcggggcggaggagggggacgcggggcggaggagggggacgcgg gggcggaggaggggctcacccgcgttcgtgccttcccgcaggaggaacgtcctcgtcgaggcgaccggcggcgaccgttgcgtggacgcttcctgctcg tcgggcgggggaagccactgtggtcctcctgggacgttttctggatggccgacatttccccaggcgcttttgcgccttgtgtaaaagcgcggcgtcccg ctctccgatccccgccctgggcacgcgcaagcgcaagcgcccttcccgcccctctcatcggagtctgaggtagaatccgatacagccttggagtctga ggtcgaatccgagacagcatcggattcgaccgagtctggggaccaggatgaagccccccgcatcggtggccgtagggccccggaggcttgggggcggt ttttctggacatgtcggcgaatccaccacggggacggaaacggatgcgtcggtgtcggacgaccccgacgacacgtccgactggtcttatgacgacatt ccccacgacccaagcgggccgggtaaacctgcggctcacgagctctcccgatcggcgggatggggttattttcctaagatggggcgggtccggtctac ccgggaaacgcagccccgggccccaccccgtcggccccaagcccaaatgcaatgctacggcgctcggtgcgccaggcccagaggcggagcagcgcacga tggaccccgacctgggctacatgcgccagtgtatcaatcagctgtttcgggtcctgcgggtcgcccgggaccccacggcagtgccaaccgcctgcgcc acctgatacgcgactgttacctgatggggatactgcccgtctggccccgcgcacgtggtgccgtttgctgcaggtgtccggcggaacctggggcatgcacc tgcgcaacaccatacgggaggtggaggctcgattcgacgccaccgcggaacccgtgtgcaagcttccttgtttggagaccagacggtacggcccggagtg tgatcttagtaatctcgagattcatctcagcgcgacaagcgatgatgaaatctccgatgccaccgatctggaggccgccggttcggaccacacgctcgcg tcccagtccgacacggaggatgccccctcccgttacgctggaaacccagaacccgcgggtccctcgctgtgcgtctggaggatgagtttggggagt ttgactggaccccccaggagggctcccagccctggctgtctgcggtcgtggccgataccagctccgtggaacgcccgggcccatccgattctgggcggg tcgcgccgcagaagaccgcaagtgtctggacggctgccggaaaatgcgcttctccaccgcctgcccctatccgtgcagcgacacgtttctccggccgtga gtccggtcgccccgacccccttgtatgtccccaaaataaaagacaaatcaaagcgtttgtcccagcgtcttaatggcgggaagggcggagagaaacagac cacgcggacatggggggtgtttgggggtttattggcaccgggggctaaagggtggtaaccggatagcagatgtgaggaagtcggggccgttcgccgcgaa cggcgatcagagggtcagtttcttgcggaccacgcccccggcgatgtgggttgctcgtctgggacctcgggcatgcccatacacgcacaacacggacgcc gcaccggatgggacgtcgtaagggggcctggggtagctgggtggggtttgtgcagagcaatcagggaccgcagccagcgcatacaatcgcgctcccgtcc gtttgtcccgggcagtaccacgccgtactggtattcgtaccggctgagcagggtctccagggggtggttgggggccgcggggaacggggtccacgccacg gtccactcgggcaaaaaccgagtcggcacggcccacggttctcccacccacgcgtctggggtcttgatggcgataaatcttaccccgagccggatttttt gggcgtattcgagaaacggcacacacagatccgccgcgcctaccacccacaagtggtagaggcgaggggggctgggttggtctcggtgcagcagtcggag cacgccacggcgtccacgacctcggtgctctccaaggggctgtcctccgcaaacaggcccgtggtggtgtttggggggcagcgacaggacctagtgcgca cgatcgggcgggtgggtttgggtaagtccatcagcggctcggccaccgtcgaaggttggccggacgaacgacgaccggggtacccaggggttctgatgcc aaaatgcggcactgcctaaagcaggaagctccacagggccgggcttgcgtcgacggaagtccggggcagggcgttgttctggtcaaggagggtcattacg ttgacgacaacaacgcccatgttggtatattacaggcccgtgtccgatttggggcacttgcagaatttgtaaggccacgcacggcggggagacaggccga cgcggggctgctctaaaaatttaagggccctacggtccacagacccgccttcccggggggcccccttgagcgaccggcagcggaggcgtccggggag gggagggtgattacgggggggtaggtcaggggtgggtcgtcaaactgccgctccttaaaaccccggggcccgtcgttcggggtgctcgttggttggcac tcacggtgcggcgaatggcctgtcgtaagttttgtcgcgtttacggggacagggcaggaggaaggaggaggccgtcccgccggagacaaagccgtccgg gtgtttcctcatggcccttttataccccagccgaggacgcgtgcctggactccccgccccggagaccccaaaccttcccacaccacaccaccagcga ggccgagcgcctgtgtcatctgcaggagatccttgcccagatgtacggaaaccaggactaccccatagaggacgaccccagcgcggatgccgcggacgat gtcgacgaggacgcccggacgacgtggcctatccggaggaatacgcagaggagcttttctaccccatagaggacgaccccagccttatcggggccaac gaccacatccctcccccgtgtggcgcatctccccccggtatacgacgacgcagccgggatgagattggggccacgggatttaccgcggaagagctggacg ccatggacaggaggcggctcgagccatcagccgcggcggcaagccccctcgaccatggccaagctggtgactggcatgggctttacgatccacggagc gctcacccaggatcggaggggtgtgtctttgacagcagccatccagattaccccccaacgggtaatcgtgaaggcgggtggtacacagagcacgagccac gaggcgcgactgctgaggcgactggaccacccggcgatcctgccccctcctggacctgcatgtcgtctccggggtcacgtgtctggtcctccccaagtacc
```

-continued aggccgacctgtatacctatctgagtaggcgcctgaacccactgggacgcccgcagatcgcagcggtctcccggcagctcctaagcgccgttgactacat tcaccgccagggcattatccaccgcgacattaagaccgaaaatattttattaacaccccgaggacatttgcctgggggactttggcgccgcgtgcttc gtgcagggttcccgatcagccccttcccctacggatcgccggaacacatcgacaccaacgccccgaggtcctggccggggatcc.

The α4 promoter gene with the unique short sequence containing the ICP47 ORF is found at nucleotides 144876-146834, and has the following sequence:

(SEQ ID NO: 8)

ggatccgtgtcggcagccgcgctccgtgtggacgatcggggcgtcctcgggctcatatagtcccaggggccggcgggaaggaggagcagcggaggccgcc ggcccccgcccccggcgggcccacccgaacggaattccattatgcacgacccgcccgacgccggcacgccggggcccgtggccgcggcccgtt ggtcgaaccccggccccgccatccgcgccatctgccatgggcggggcgcgagggcgggtggtccgcgccccgccccgcatggcatctcattaccgcc cgatccggcggtttccgcttccgttccgcatgctaacgaggaacgggcaggggcggggcccgggccccgacttcccggttcggcggtaatgagatacga gccccgcgcgccgttggccgtccccgggcccccggtcccgcccgccggacgccgggaccaacgggacggcgggcggcccaagggccgcccgccttgcc gcccccccattggccggcgggcgggaccgcccaagggggcggggccgccgggtaaaagaagtgagaacgcgaagcgttcgcacttcgtcccaatatata tatattattagggcgaagtgcgagcactggcgccgtgcccgactccgcgccggccccggggcgggcccgggcggcggggggcggtctctccggcgcac ataaaggcccggcgcgaccgacgcccgcagacggcgccggccacgaacgacgggagcggctgcggagcacgcggaccgggagcggggagtcgcagagggc cgtcggagcggacggcgtcggcatcgcgacgcccggctcggatcgggatcgcatcggaaagggacacgcggacgcggggggaaagacccgcccacca aggcccggcgcgaccgacgcccgcagacggcgccggccacgaacgacgggagcgctgcggagcacgcggaccgggagcgggagtcgcagagggccgtcgg agcggacggcgtcgcatcgcgacgcccggctcggatcgggatcgcatcggaaagggacacgcgacgcgggggggaaagacccgcccaccccacccacg aaacacaggggacgcaccccggggggcctccgacgacagaaacccaccggtccgccttttttgcacgggtaagcaccttgggtgggcggaggaggggggga cgcggggcggaggaggggggacgcggggcggaggaggggggacgcggggcggaggaggggggacgcggggcggaggagggggacgcggggcgga ggaggggctcacccgcgttcgtgccttcccgcaggaggaacgtcctcgaggcgaccggcggcgaccgttgcgtggaccgcttcctgctcgtcgggcggg gggaagccactgtggtcctccgggacgttttctggatggccgacatttccccaggcgcttttgcgccttgtgtaaaagcgcggcgtcccgctctccgatc cccgccctgggcacgcgcaagcgcaagcgcccttcccgccccctctcatcggagtctgaggtagaatccgatacagcttggagtctgaggtcgaatcc gagacagcatcggattcgaccgagtctggggaccaggatgaagcccccgcatcggtggccgtagggccccccggaggcttgggggcggtttttctgg acatgtcggcggaatccaccacggggacggaaacggatgcgtcggtgtcggacgaccccgacgacacgtccgactggtcttatgacgacattcccccacg acccaagcgggcccgggtaaacctgcggctcacgagctctcccgatcggcgggatggggttatttttcctaagatggggcgggtccggtctacccgggaa acgcagccccgggcccccacccgtcggccccaagcccaaatgcaatgctacggcgctcggtgcgccaggcccagaggcggagcagcgcacgatggaccc ccgacctgggctacatgcgccagtgtatcaatcagctgtttcgggtcctgcgggtcgcccgggaccccacggcagtgccaaccgcctgcgccacctgat acgcgactgttacctgatgggatactgccgagcccgtcctggccccgcgcacgtggtgccgtttgctgcaggtgtcccggcggaacctggggcatgcacc tgcgcaacaccatacgggaggtggaggctcgattcgacgccaccgcggaacccgtgtgcaagcttccttgtttggagaccagacggtacggcccggagtg tgatcttagtaatctcgagattcatctcagcgcgacaagcgatgatgaaatctccgatgccaccgatctggaggccgccggttcggaccacacgctcgcg tcccagtccgacacggaggatgcccctccccgttacgctggaaacccagaacccgcgggtccctcgctgtgcgtctggaggatgagtttggggagt ttgactggaccccccaggagggctcccagccctggctgtctgcggtcgtggccgataccagctccgtggaacgcccgggcccatccgattctgggcggg tcgcgccgcagaagaccgcaagtgtctggacggctgcccggaaaatgcgcttctccaccgcctgcccctatccgtgcagcgacacgtttctccggccgtg agtccggtcgccccgaccccttgtatgtcccaaaataaagaccaaatcaaagcgtttgtcccagcgtcttaatggcgggaagggcggagagaaacag accacgcggacatgggggggtgttgggggtttattggcaccggggggctaaagggtggtaaccggatagcagatgtgaggaagtcggggccgttcgccgcga acggcgatcagagggtcagtttcttgcggaccacggcccggcgatgtgggttgctcgtctggacctcgggcatgcccatacacgcacaacacggacgcc gcaccggatgggacgtcgtaaggggggcctgggtagctgggtgggtttgtgcagagcaatcagggaccgcagccagcgcaatacaatcgcgctcccgtc cgtttgtcccgggcagtaccacgccgtactggtattcgtaccggctgagcagggtctccagggggtggttgggggccgcggggaacggggtccacgccac ggtccactcgggcaaaaaccgagtcggcacggcccacggttctcccacccacgcgtctgggtcttgatggcgataaatcttaccccgagccggattttt -continued

```
tgggcgtattcgagaaacggcacacacagatccgccgcgcctaccacccacaagtggtagaggcgagggggctgggttggtctcggtgcagcagtcgga
agcacgccacggcgtccacgacctcggtgctctcaaggggctgtcctccgcaaacaggcccgtggtggtgtttgggggcagcgacaggacctagtgcg
cacgatcgggcgggtgggtttgggtaagtccatcagcggctcggccaaccgtcgaaggttggccggacgaacgacgaccggggtacccaggggttctgat
gccaaaaatgcggcactgcctaagcaggaagctccacagggccgggcttgcgtcgacggaagtccggggcagggcgttgttctggtcaaggagggtcatt
acgttgacgacaacaacgcccatgttggtatattacaggcccgtgtccgatttgggcacttgcagatttgtaaggccacgcacggcggggagacaggcc
gacgcgggggctgctctaaaaatttaaggccctacggtcccacagacccgcctcccggggggggccttggagcgaccggcagcggaggcgtccggggga
ggggagggtgatttacgggggggtaggtcaggggtgggtcgtcaaactgccgctccttaaaaccccggggcccgtcgttcggggtgctcgttggttggg
cactcacggtgcggcgaatggcctgtcgtaagttttgtcgcgtttacggggacagggcaggaggaaggaggaggccgtcccgcggagacaaagccgtcc
cgggtgtttcctcatggcccctttttataccccagccgaggacgcgtgcctggactccccgccccggagaccccaaaccttcccacaccacaccaccca
gcgaggccgagcgcctgtgtcatctgcaggagatccttgccccagatgtacggaaaccaggactacccatagaggacgaccccagcgcggatgccgcgg
acgatgtcgacgaggacgccccggacgacgtggcctatccggaggaatacgcagaggagcttttctgcccggggacgcgaccggtcccttatcgggc
cacgaccacatccctcccccgtgtggcgcatctcccccggtatacgacgacgcagccgggatgagattggggccacgggatttaccgcggaagagctgg
acgccatggacaggaggcggctcgaggcggctcgagccatcagccgcggcggcaagcccccctcgaccatggccaagctggtgactggcatgggcttta
cgatccacggagcgctcacccaggatcggaggggtgtgctttgacagcagccatccagattaccccaacgggtaatcgtgaaggcggggtggtacacg
agcacgagccacgaggcgcgactgctgaggcgactggaccacccggcgatcctgcccctcctggacctgcatgtcgtctccggggtcacgtgtctggtcc
tccccaagtaccaggccgacctgtatacctatctgagtaggcgcctgaacccactgggacgcccgcagatcgcagcggtctcccggcagctcctaagcgc
cgtgactacattcaccgccagggcattatccaccgcgacattaagaccgaaaatatttttattaacaccccgaggacatttgcctgggggacttggcgc
cgcgtgcttcgtgcagggttcccgatcagccccttccctacggaatcgccggaaccatcgacaccaacgccccgaggtcctggccggggatcc.
```

The α22 promoter gene is found at nucleotides 131249-132604, and has the following sequence:

(SEQ ID NO: 9)
```
gtcgacgcggaactagcgcggaccggtcgatgcttgggtgggaaaaagga
caggacggccgatcccctcccgcgcttcgtccgcgtatcggcgtcccgg
cgcggcgagcgtctgacggtctgtctggcggtcccgcgtcgggtcgtgga
tccgtgtcggcagccgcgctccgtgtggacgatcggggcgtcctcgggct
catatagtcccaggggccggcgggaaggaggagcagcggaggccgccggc
ccccccggcgggcccacccccgaacggaattccattatgcacgaccccgcc
ccgacgccggcacgccggggggcccgtggccgcggcccgttggtcgaaccc
ccggccccgccatccgcgccatctgccatggggcggggcgcgagggcgg
gtgggtccgcgccccgccccgcatggcatctcattaccgcccgatccggc
ggtttccgcttccgttccgcatgctaacgaggaacgggcaggggggcggg
gcccgggccccgacttcccggttcggcggtaatgagatacgagcccgcg
cgcccgttggccgtcccgggccccccggtcccgcccgccggacgccggg
accaacgggacggcgggcggcccaagggccgcccgccttgccgcccccc
attggccggcgggcgggaccgccccaaggggggcggggccgccgggtaaaa
gaagtgagaacgcgaagcgttcgcacttcgtcccaatatatatatattat
tagggcgaagtgcgagcactggcgccgtgcccgactccgcgccggcccg
ggggcgggcccgggcggcggggggcgggtctctcggcgcacataaaggc
ccggcgcgaccgacgcccgcagacggcgccggccacgaacgacgggagcg
gctgcggagcacgcggaccgggagcgggagtcgcagagggccgtcggagc
```

-continued
```
ggacggcgtcggcatcgcgacgccccggctcgggatcgggatcgcatcgg
aaagggacacgcggacgcgggggggaaagacccgcccaccccaccacga
aacacaggggacgcaccccgggggccctccgacgacagaaacccaccggt
ccgccttttttgcacgggtaagcaccttgggtgggcggaggaggggggga
cgcgggggcggaggaggggggacgcgggggcggaggaggggggacgcggg
ggcggaggaggggggacgcgggggcggaggaggggggacgcggggcgga
ggaggggctcacccgcgttcgtgccttcccgcaggaggaacgtcctcgt
cgaggcgaccggcggcgaccgttgcgtggaccgcttcctgctcgtcggg
```

The α27 promoter gene is found at nucleotides 111990-113647, and has the following sequence:

(SEQ ID NO: 10)
```
cctgcagcaaagcctgtcgtgtctgcgctttaagcacggccgggcgagtc
gcgccacgcgcggacattcgtcgcgctgagcgtcggggccaacaaccgc
ctgtgcgtgtccttgtgtcagcagtgctttgccgccaaatgcgacagcaa
ccgcctgcacacgctgtttaccattgacgccggcacgccatgctcgccgt
ccgttccctgcagcacctctcaaccgtcgtcttgataacggcgtacggcc
tcgtgctcgtgtggtacaccgtcttcggtgccagtccgctgcaccgatgt
atttacgcggtacgccccaccggcaccaacaacgacaccgccctcgtgtg
gatgaaaatgaaccagaccctattgtttctggggccccgacgcaccccc
ccaacggggctggcgcaaccacgcccatatctgctacgccaatcttatc
gcgggtagggtcgtgcccttccaggtcccacctgacgccatgaatcgtcg
gatcatgaacgtccacgaggcagttaactgctggagaccctatggtacac
```

-continued

```
acgggtgcgtctggtggtcgtagggtggttcctgtatctggcgttcgtcg ccctccaccaacgccgatgtatgtttggcgtcgtgagtcccgcccacaag atggtggcccggccacctacctcctgaactacgcaggccgcatcgtatc gagctcttcctgcagtaccctacacgaaaattacccgcctgctctgcgag ctgtcggtccagcggcaaaacctggttcagttgtttgagacggaccggt caccttcttgtaccaccgcccgccatcggggtcatcgtaggctgcgagt tgatgctacgctttgtggccgtggggtctcatcgtcggcaccgctttcat atcccggggggcatgtgcgatcacatacccctgtttctgaccatcacca cctggtgttttgtctccaccatcggcctgacagagctgtattgtattctg cggcggggcccggccccaagaacgcagacaaggccgccgccccggggcg atccaagggctgtcgggcgtcgcgggcgctgctgttccatcatcctctc gggcatcgcagtgcgattgtgttatatcgccgtggtggccggggtggtgc tcgtggcgcttcactacgagcaggagatccagaggcgcctgtttgatgta tgacgtcacatccaggccggcggaaaccgtaacggcatatcgaaattgga aactgtcctgtcttggggcccacccacccgacgcgtcatatgcaaatgaa atcggtccccgaggccacgtgtagcctggatcccaacgaccccgcccat gggtcccaaatggccgtcccgttaccaagaccaacccagccagcgtatcc accccgcccgggtccccgcggaagcggaacggggtatgtgatatgctaa ttaaatacatgccacgtacttatggtgtctgattggtccttgtctgtgcc ggaggtggggcggggcccgccggggggcggaacgaggaggggtttgg gagagccggccccggcaccacgggtataaggacatccaccacccggcgg tggtggtgtgcagccgtgttccaaccacggtcacgcttcggtgcctctcc ccga.
```

The α47 promoter gene is found at nucleotides 145585-146984, and has the following sequence:

```
                                    (SEQ ID NO: 11)
cccgacgagcaggaagcggtccacgcaacggtcgccgccggtcgcctcga cgaggacgttcctcctgcgggaaggcacgaacgcgggtgagcccctcct ccgccccgcgtccccctcctccgccccgcgtccccctcctccgccc ccgcgtccccctcctccgccccgcgtccccctcctccgccccgcgt cccccctcctccgccccgcgtcccccctcctccaccccgcgtcccccc ctcctccgcccacccaaggtgcttaccgtgcaaaaaggcggaccggtg ggtttctgtcgtcggaggccccggggtgcgtcccctgtgtttcgtgggt ggggtgggcgggtctttccccccgcgtccgcgtgtcccttccgatgcg atcccgatcccgagccggggcgtcgcgatgccgacgccgtccgctccgac ggccctctgcgactcccgctcccggtccgcgtgctccgcagccgctcccg tcgttcgtggccggcgcgtctgcgggcgtcggtcgcgccgggcctttat gtgcgccggagagaccccgccccgccgccgggccccgccccggggccg gcgcggagtcgggcacggcgccagtgctcgcacttcgccctaataatata tatatattgggacgaagtgcgaacgcttcgcgttctcacttatttacccg
```

```
gcggccccgcccccttggggcggtcccgcccgccggccaatggggggcg gcaaggcgggcggcccttgggccgccgccgtcccgttggtcccggcgtc cggcgggcgggaccgggggcccggggacggccaacgggcgcgcggggct cgtatctcattaccgccgaaccgggaagtcggggcccgggcccgcccc tgcccgttcctcgttagcatgcggaacggaagcggaaaccgccggatcgg gcggtaatgagatgccatgcggggcggggcgcggacccaccgccctcgc gccccgccatggcagatggcgcggatgggcggggccgggggttcgacca acgggccgcggccacgggccccggcgtgccggcgtcggggcgggtcgt gcataatggaattccgttcggggtgggcccgccggggggcgggggccg gcggcctccgctgctcctccttcccgccggccctgggactatatgagcc cgaggacgcccgatcgtccacacggagcgcggctgccgacacggatcca cgacccgacgcgggaccgccagagacagaccgtcagacgctcgccgcgcc gggacgccgatacgcggacgaagcgcgggagggggatcggccgtccctgt cattttcccacccaagcatcgaccggtccgcgctagttccgcgtcgac.
```

Mutations may be made in the variant HSV by homologous recombination methods well known to those skilled in the art. For example, HSV genomic DNA is transfected together with a vector, preferably a plasmid vector, comprising the mutated sequence flanked by homologous HSV sequences. The mutated sequence may comprise a deletion(s), insertion(s) or substitution(s), all of which may be constructed by routine techniques. Insertions may include selectable marker genes, for example lacZ or green fluorescent protein (GFP), which may be used for screening recombinant viruses, for example, β-galactosidase activity or fluorescence. In a preferred embodiment, the selectable marker is the IE-Us11 gene.

The generation of variant HSV having intact endogenous Us11 and Us12 genes and a Us11 gene operatively associated with an IE promoter inserted into the $\gamma_1 34.5$ locus is described in detail in U.S. Pat. No. 7,731,952 by Mohr et al. The instant invention provides improved variant HSV that are based on the variant HSV described in U.S. Pat. No. 7,731,952, and that further comprise one or more genes encoding heterologous polypeptides. As described herein, preferably, the heterologous peptides are inserted into the same region of the HSV genome as the IE-Us11 gene (i.e., the $\gamma_1 34.5$ locus).

The heterologous polypeptide encoding genes described herein may be inserted into the viral genome by any suitable technique such as homologous recombination of HSV strains with, for example, plasmid vectors carrying the gene flanked by HSV sequences. For example, a gene encoding a heterologous polypeptide can be inserted into a gene expression cassette, according to the methods described in U.S. Pat. No. 7,731,952 for insertion of IE-Us11. As described in Examples 2 and 3, below, for example, the heterologous polypeptide encoding gene may be fused to a CMV or EF1α promoter in an expression cassette, and this expression cassette may be inserted into a targeting vector in place of $\gamma_1 34.5$. The expression cassette may be designed to have flanking sequences that mediate homologous recombination into the $\gamma_1 34.5$ locus. Preferably, the one or more genes encoding a heterologous polypeptide are inserted at the same site in the HSV genome as the IE-Us11 gene, for example, by including them on the same polynucleotide cassette as the IE-Us11 gene. However, the one or more genes encoding a heterologous polypeptide may also be inserted at other sites. In variant HSV comprising two genes encoding heterologous polypeptides, expression of each gene may be driven by separate promoters, for example a CMV promoter and an EF1α promoter, or two CMV promoters or two EF1α promoters arranged in opposite orientation or from a single promoter, e.g., one CMV or EF1α promoter driving expression of both genes. Where both heterologous polypeptide encoding genes are expressed from a single promoter, the genes may be separated by an internal ribosome entry site (IRES). The genes may also be expressed as a translational fusion such that the fused polypeptide retains both activities of the separate genes (e.g., prodrug activation and cell to cell fusion, prodrug activation and immunomodulatory activity or cell to cell fusion and immunomodulatory activity) such that the fused polypeptides are cleaved following expression by a protease either in cis or in trans to the fused polypeptide. It is also possible that the fused polypeptides are not separated by a cleavage site but still retain the activities of the separate genes.

The transcribed sequences of the inserted genes are preferably operably associated with control sequences permitting expression of the genes in a tumor cell. A control sequence typically comprises a promoter allowing expression of the gene operably associated therewith and signal for termination of transcription. The promoter is selected from promoters which are functional in mammalian, preferably human tumor cells. The promoter may be derived from promoter sequences of a eukaryotic gene. For example, the promoter may be derived from the genome of a cell in which expression of the heterologous gene is to occur, preferably a mammalian tumor cell, more preferably a human tumor cell. With respect to eukaryotic promoters, they may be promoters that function in a ubiquitous manner (such as promoters of β-actin, tubulin) or, alternatively, in a tumor-specific manner. They may also be promoters that respond to specific stimuli, for example promoters that bind steroid hormone receptors. Viral promoters may also be used, for example the Moloney murine leukaemia virus long terminal repeat (MMLV LTR) promoter or other retroviral promoters such as that derived from Rous sarcoma virus (RSV), the human or mouse cytomegalovirus (CMV) IE promoter or promoters of herpes virus genes including those driving expression of the latency associated transcripts.

Expression cassettes and other suitable constructs comprising the prodrug converting enzyme encoding gene, gene encoding a polypeptide capable of promoting cell to cell fusion and/or immunomodulatory gene and control sequences can be made using routine cloning techniques known to persons skilled in the art (see, for example, Sambrook et al., 1989, Molecular Cloning—A laboratory manual; Cold Spring Harbor Press).

It may also be advantageous for the promoter(s) to be inducible so that the levels of expression of the genes can be regulated during the life-time of the tumor cell. Inducible means that the levels of expression obtained using the promoter can be regulated. For example, a virus of the invention may further comprise a heterologous gene encoding the tet repressor/VP16 transcriptional activator fusion protein under the control of a strong promoter (e.g., the CMV IE promoter) and the prodrug converting, cell to cell fusion or immunomodulatory or other gene may be under the control of a promoter responsive to the tet repressor VP16 transcriptional activator fusion protein previously reported (see, Gossen et al., "Tight control of gene expression in mammalian cells by tetracycline-responsive promoters," Proc. Natl. Acad. Sci. USA, 89: 5547-5551, 1992, Gossen et al., "Transcriptional activation by tetracyclines in mammalian cells," Science, 268: 1766-1769, 1995). Thus, in this example, expression of the gene(s) would depend on the presence or absence of tetracycline.

In a specific embodiment, the heterologous polypeptide encoding gene, e.g., in a gene expression cassette, may be inserted, preferably into the $\gamma_1 34.5$ locus, such that it has the same orientation as the IE-Us11 gene or the opposite orientation. Furthermore, the heterologous polypeptide may be inserted either upstream or downstream of the IE-Us11 gene. When two heterologous polypeptide encoding genes are present, each gene may be present in either orientation, i.e., the first and second heterologous polypeptide encoding genes can each have either the same or opposite orientation as the IE-Us11 gene. Preferably, in a variant HSV comprising two heterologous polypeptide encoding genes, one of those genes is expressed from a CMV promoter, and the other from an EF1α promoter, wherein the promoters (and genes) are placed in a back-to-back orientation with respect to each other and inserted into the HSV genome so as to replace the genes encoding ICP34.5. However, other promoters may also be used. The polynucleotide cassettes used to make the variant HSV of the invention are shown in FIGS. 2, 3A-3D, and 4. The heterologous polypeptide genes may also be inserted into the viral genome at other location(s) in the viral genome, however, provided that the desired oncolytic properties and, preferably, immune evasion abilities of the variant HSV, are retained.

Variant HSV of the invention can also encode multiple heterologous genes (e.g., prodrug converting enzyme encoding genes, genes encoding a polypeptide capable of promoting cell to cell fusion and/or immunomodulatory genes). Variant HSV of the invention may comprise one or more additional genes, for example from 1, 2 to 3, 4 or 5 additional genes. The additional gene(s) may be further copies of the heterologous polypeptide encoding gene(s). The additional gene(s) may encode one or more different prodrug converting gene, one or more different fusiogenic gene and/or one or more different immunomodulatory gene and/or one or more matrix modifying enzymes. The additional gene(s) may encode other gene(s) intended to enhance the therapeutic effect.

More than one gene and associated control sequences could be introduced into a particular HSV either at a single site or at multiple sites in the virus genome. Alternatively pairs of promoters (the same or different promoters) facing in opposite orientations away from each other, each driving the expression of a gene may be used.

In certain embodiments, a gene encoding a heterologous polypeptide is a prodrug activating enzyme, a heterologous gene encoding a polypeptide capable of causing cell to cell fusion or a heterologous gene encoding an immunomodulatory polypeptide. In a preferred embodiment, the variant HSV comprises at least two (2) genes encoding heterologous polypeptides.

A prodrug activating polypeptide can be a cytosine deaminase enzyme, which is capable of converting the inactive prodrug 5-fluorocytosine to the active drug 5-fluorouracil. Various cytosine deaminase genes are available including those of bacterial origin and of yeast origin. A second gene, typically a gene encoding a second enzyme, may be used to enhance the prodrug conversion activity of the cytosine deaminase gene. For example, the second gene may encode a uracil phosphoribosyltransferase.

Any suitable fusogenic gene encoding a polypeptide capable of causing cell to cell fusion may be used. Preferably the polypeptide capable of causing cell to cell fusion is selected from a modified retroviral envelope glycoprotein, such as an envelope glycoprotein derived from gibbon ape leukaemia virus (GALV) or human endogenous retrovirus W, a fusogenic F or H protein from measles virus and the vesicular stomatitis virus G protein. More preferably, the polypeptide capable of causing cell to cell fusion is a GALV fusogenic glycoprotein (see, Simpson et al. (2006) "Combination of a Fusogenic Glycoprotein, Prodrug Activation, and Oncolytic Herpes Simplex Virus for Enhanced Local Tumor Control." Cancer Res; 66:9: 4835-4842).

The immunomodulatory gene may be any gene encoding a polypeptide that is capable of modulating an immune response. The polypeptide capable of modulating an immune response may be a polypeptide capable of inhibiting antigen presentation on class I MHC molecules, for example, a TAP inhibitor (such as certain UL49.5 polypeptides (e.g., from BHV), human CMV US3 and US6, HSV Us12/ICP47, EBV, or BNLF2a) or a class I MHC molecule maturation inhibitor (e.g., murine CMV mK3, human CMV US2 and US11 (not related to HSV Us11), and varicella zoster virus ORF66). The polypeptide capable of modulating an immune response also may be a cytokine such as, but not limited to, GM-CSF, TNF-α, an interleukin (for example IL12), an interferon (such as IFNγ) a chemokine such as RANTES or a macrophage inflammatory protein (MIP) (for example, MIP-3), or another immunomodulatory molecule such as B7.1 (CD80), B7.2 (CD86) or CD40L.

The polypeptide capable of causing cell to cell fusion may also be capable of modulating an immune response. For example, GALV is capable of modulating an immune response. Variant HSV of the invention may thus be used to deliver the genes to a cell in vivo where they will be expressed.

Non-limiting examples of TAP-inhibitor genes include UL49.5, e.g., from bovine herpesvirus (BHV), which is capable of inhibiting mouse and human TAP (van Hall et al., J. Immunology (2007) 178:657-662). UL49.5 polypeptides can also be derived from pseudorabies virus (PRV) and equine herpesvirus 1 and 4 (EHV-1 and EHV-4). These UL49.5 proteins interfere with MHC class I antigen presentation by blocking the supply of antigenic peptides through inhibition of TAP and are active on rodent TAP, such as murine TAP. Other examples of TAP inhibitors include UL49.5 polypeptides from bubaline herpesvirus 1, cervid herpesvirus 1, felid herpesvirus 1, (see, Verweij et al. 2011 "Structural and functional analysis of the TAP-inhibiting UL49.5 proteins of varicelloviruses." Mol. Immunol. July 15 Epub) and BNLF2a and ICP47. It is noted that UL49.5 homolog from HSV-1 and HSV-2 do not inhibit TAP [see, Koppers-Lalic, D. et al. (2008) *PLoS*; 4(5): e1000080].

Non-limiting examples of marix medifying enzymes are: matrix metalloproteinases such as collagenases, gelatinases and stromelysins, relaxin, bacterial collagenase and chondroitinase ABC I.

Although the invention is not limited by any particular theory or mechanism of action, the insertion of the gene for mammalian GM-CSF into the genome of the variant HSV of the invention can enhance anti-tumor responses both locally and at sites distant to where the variant HSV is injected by stimulating T-cell mediated immune responses. GM-CSF is the principal mediator of proliferation, maturation, and migration of dendritic cells, the most potent antigen presenting cells of the immune system. Dendritic cells display antigens on their surface in conjunction with class II major histocompatibility complex (MHC-II). Once presented on MHC class II molecules, the antigen can be recognized by helper CD4+ T cells, which provide support for the development of B cells and cytolytic CD8+ T cells. Expression of GM-CSF in the local tumor environment serves to achieve several biologic goals: (a) induces local inflammation, (b) enhances dendritic cell activity, and (c) increases HLA class II expression. Further, in certain embodiments, cytokines having similar activity as GM-CSF, as described above, are also contemplated for use in the present invention. Under such increased immune recruitment and activation conditions, immunomodulatory polypeptides that lead to enhanced immune recruitment and activation could be deleterious to viral infection and spread. For this reason, the enhanced immune evasion capabilities of the variant HSV of the invention (provided by the heterologous gene encoding an inhibitor of class I MHC molecule antigen presentation (e.g., TAP inhibitor)) are particularly important for promoting viral replication, spread and efficacy.

In other embodiments, using standard molecular and virological techniques, an oncolytic virus strain (e.g., OV-2711) may be modified to create novel, cancer-specific variant HSV of the present invention. For example, variant HSV may be engineered according to the invention where PI-3-kinase signaling is constitutively activated, e.g., by deleting the virus-encoded Akt mimic Us3. Alternatively, a key viral surface glycoprotein may be altered, such that the virus preferentially enters cells within the urothelium. Variant HSV of the invention may have either one or both of these modifications, and their oncolytic activity may be evaluated in both cell culture and animal models well known in the art.

Pharmaceutical Compositions

Pharmaceutical compositions include an active agent and a pharmaceutically acceptable carrier, excipient, or diluent.

The term "carrier" refers to a diluent, adjuvant, excipient, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Alternatively, the carrier can be a solid dosage form carrier, including but not limited to one or more of a binder (for compressed pills), a glidant, an encapsulating agent, a flavorant, and a colorant. Suitable pharmaceutical carriers are described in "Remington's Pharmaceutical Sciences" by E. W. Martin.

When formulated in a pharmaceutical composition, a therapeutic compound of the present invention can be admixed with a pharmaceutically acceptable carrier or excipient. As used herein, the phrase "pharmaceutically acceptable" refers to molecular entities and compositions that are generally believed to be physiologically tolerable and do not typically produce an allergic or similar untoward reaction, such as gastric upset, dizziness and the like, when administered to a human.

The term "pharmaceutically acceptable derivative" as used herein means any pharmaceutically acceptable salt, solvate or prodrug, e.g. ester, of a compound of the invention, which upon administration to the recipient is capable of providing (directly or indirectly) a compound of the invention, or an active metabolite or residue thereof. Such derivatives are recognizable to those skilled in the art, without undue experimentation. Nevertheless, reference is made to the teaching of Burger's Medicinal Chemistry and Drug Discovery, 5th Edition, Vol 1: Principles and Practice, which is incorporated herein by reference to the extent of teaching such derivatives. Preferred pharmaceutically acceptable derivatives are salts, solvates, esters, carbamates, and phosphate esters. Particularly preferred pharmaceutically acceptable derivatives are salts, solvates, and esters. Most preferred pharmaceutically acceptable derivatives are salts and esters.

While it is possible to use a composition provided by the present invention for therapy as is, it may be preferable to administer it in a pharmaceutical formulation, e.g., in admixture with a suitable pharmaceutical excipient, diluent, or carrier selected with regard to the intended route of administration and standard pharmaceutical practice. Accordingly, in one aspect, the present invention provides a pharmaceutical composition or formulation comprising at least one active composition, or a pharmaceutically acceptable derivative thereof, in association with a pharmaceutically acceptable excipient, diluent, and/or carrier. The excipient, diluent and/or carrier must be "acceptable" in the sense of being compatible with the other ingredients of the formulation and not deleterious to the recipient thereof.

The compositions of the invention can be formulated for administration in any convenient way for use in human or veterinary medicine.

For human therapy, the pharmaceutical compositions, including each of the active agents, will be prepared in accordance with good manufacturing process (GMP) standards, as set by the Food & Drug Administration (FDA). Quality assurance (QA) and quality control (QC) standards will include testing for purity and function and other standard measures.

A preferred delivery vehicle is any chemical entity that ensures delivery of a variant HSV to a tumor cell in a selective manner, achieves sufficient concentration of variant HSV in the tumor cell. This can include, without limitation, standard pharmaceutical dosage forms for the delivery of a virus (e.g., solutions, suspensions, emulsions) with or without controlled release. Other dosage forms, e.g., solid dosage forms such as, but not limited to, crystals or beads may also be used.

Therapeutic Uses

In certain embodiments, the present invention provides methods for killing tumor cells in a subject and for treating cancers, including, in preferred embodiments, bladder cancer. In one embodiment, an oncolytic or other virus of the invention can be used in a "stand alone" or monotherapy to treat such cancers. However, the invention also includes methods and compositions where an oncolytic or other virus of the invention is combined with at least one other therapeutic substance or treatment modality for treating cancer. In a preferred embodiment, the other therapeutic substance is cisplatin. However, any chemical or other agent used to treat bladder or other cancers can be used. Non-limiting examples of cancers that can be treated using the variant HSV of the invention include, e.g., prostate cancer, glioma, melanoma, colon cancer, ovarian cancer, breast cancer, head/neck cancer, and including all solid tumors.

The specific conditions (e.g., appropriate pharmaceutical carrier, dosage, site and route of administration, etc.) under which a variant HSV-containing composition of the invention should be administered in order to be effective for killing tumor cells or for treating cancer is an individual can be determined, e.g., by the individual's physician.

Individuals that can be treated according to the methods described herein include mammals, such as rodents, dogs, cats, etc., and including humans.

Variant HSV of the invention may be used in a method of treating the human or animal body. In particular, viruses of the invention may be used in methods of cancer therapy.

Preferably, variant HSV of the invention are used in the oncolytic treatment of cancer. Viruses of the invention may be used in the therapeutic treatment of any solid tumor in a mammal, preferably a human. For example viruses of the invention may be administered to a subject with prostate, breast, lung, liver, renal cell, endometrial, bladder, colon or cervical carcinoma; adenocarcinoma; melanoma; lymphoma; glioma; sarcomas such as soft tissue and bone sarcomas; or cancer of the head and neck, and, preferably, bladder cancer.

The term "cancer" refers to all types of cancer, neoplasm or malignant tumors found in mammals, including leukemia, carcinomas and sarcomas. Exemplary cancers include cancer of the breast, brain, cervix, colon, head & neck, liver, kidney, lung, non-small cell lung, melanoma, mesothelioma, ovary, sarcoma, stomach, uterus and Medulloblastoma. Additional examples include, Hodgkin's Disease, Non-Hodgkin's Lymphoma, multiple myeloma, neuroblastoma, ovarian cancer, rhabdomyosarcoma, primary thrombocytosis, primary macroglobulinemia, primary brain tumors, malignant pancreatic insulanoma, malignant carcinoid, urinary bladder cancer, premalignant skin lesions, testicular cancer, lymphomas, thyroid cancer, neuroblastoma, esophageal cancer, genitourinary tract cancer, malignant hypercalcemia, endometrial cancer, adrenal cortical cancer, neoplasms of the endocrine and exocrine pancreas, and prostate cancer.

The term "carcinoma" refers to a malignant new growth made up of epithelial cells tending to infiltrate the surrounding tissues and give rise to metastases. Exemplary carcinomas include, for example, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniformi carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypemephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, nasopharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, and carcinoma villosum.

In certain embodiments, the compositions provided herein are useful for killing tumor cells selected from the group consisting of astrocytoma, oligodendroglioma, meningioma, neurofibroma, glioblastoma, ependymoma, Schwannoma, neurofibrosarcoma, medulloblastoma, melanoma cells, pancreatic cancer cells, prostate carcinoma cells, breast cancer cells, lung cancer cells, colon cancer cells, hepatoma cells, mesothelioma and epidermoid carcinoma cells.

In one embodiment, the cancer to be treated is bladder cancer. Bladder cancer (BC) is the fifth most common human malignancy and the second most common genitourinary tumor. Intensive surveillance with cystoscopies, urinary cytologies, and frequent tumor resections under anesthesia make BC the most costly malignancy to treat. Despite advances in intravesical and systemic chemotherapy, immunotherapy, and surgery, the efficacy of present treatment options remains limited and the response transient. Significant problems still remain in managing BC patients. Notably, failure rates for treating high-grade superficial and invasive BC remain unacceptably high. In addition, current treatments not only adversely affect patient morbidity, but also present a large economic burden. Newer, more effective therapies that both improve patient outcomes and are more cost-effective would fill a significant need.

70-80% of BCs are non-invasive, of which two-thirds initially respond to Bacillus Calmette-Guérin (BCG) immunotherapy. The remaining 20-30% are invasive with high malignant potential and limited options beyond radical cystectomy. Even for non-invasive BC, currently available treatments offer limited, transient efficacy: 80% of patients with non-invasive disease recur and 20-30% progress to potentially lethal disease. For many of these patients, having relapsed after BCG therapy or been diagnosed with highly invasive tumors, even radical surgery is likely to be ineffective. Overall responses to 'standard' cisplatin-based combination regimens vary between 39-65%, with 15-25% complete-responders and median survivals up to 16 months. Patients with unresectable metastatic BC also face grim odds with a median survival of only 7-20 months and 50% mortality after 5 years. Even following cystectomy, survival varies from 36-48% at 5 years. Since conventional chemotherapy, immunotherapy, and surgery have not improved response rates, a pressing unmet medical need exists to develop new approaches that use different modalities to destroy BC and reduce mortality.

BC represents an attractive target for variant-HSV therapy since i) new approaches for treating non-invasive and invasive BC are needed; ii) the bladder is a confined reservoir and intravesical instillation of biologics such as BCG is an established delivery mode; and iii) clinical use of BCG demonstrates that the immune system can be harnessed to attack BC. While both BCG and HSV-based-therapy stimulate anti-tumor immunity, only HSV oncolytic viruses also directly kill cancer cells and spread through tumor tissue. Thus, variant HSV as describe herein can have an impact on treating invasive BC, against which BCG is ineffective.

Melanoma, such as metastatic melanoma is another target for treatment with the oncolytic viruses described herein, e.g., in Example 3, below. Until the approval in 2011 of ipilimumab and zelboraf, no new therapeutics for the treatment of metastatic melanoma had been approved for approximately 20 years. Despite the impressive initial response rates seen in Phase 3 clinical trials for ipilimumab and zelboraf, the rates of complete responses are very low for both drugs. Novel therapeutics such as the oncolytic viruses provided herein are thus needed.

Novel therapeutics for other cancers, such as, but not limited to, ovarian cancer and glioblastoma are also needed.

Compositions for killing tumor cells and/or for treating cancer in a subject can be advantageously used in combination with other treatment modalities, including without limitation radiation, chemotherapy, thermotherapy, molecular targeted therapies, and surgery.

Chemotherapeutic agents used in the methods described herein include without limitation taxol, taxotere and other taxoids (e.g., as disclosed in U.S. Pat. Nos. 4,857,653; 4,814,470; 4,924,011, 5,290,957; 5,292,921; 5,438,072; 5,587,493; European Patent No. EP 253 738; and PCT Publication Nos. WO 91/17976, WO 93/00928, WO 93/00929, and WO 96/01815), cisplatin, carboplatin, (and other platinum intercalating compounds), etoposide and etoposide phosphate, bleomycin, mitomycin C, CCNU, doxorubicin, daunorubicin, idarubicin, ifosfamide, methotrexate, mercaptopurine, thioguanine, hydroxyurea, cytarabine, cyclophosphamide, nitrosoureas, mitomycin, dacarbazine, procarbizine, campathecins, dactinomycin, plicamycin, mitoxantrone, asparaginase, vinblastine, vincristine, vinorelbine, paclitaxel, docetaxel, calicheamicin, and the like.

Typical radiation therapy includes without limitation radiation at 1-2 Gy. Examples of radiation therapy include without limitation γ-radiation, neutron beam radiotherapy, electron beam radiotherapy, proton therapy, brachytherapy, and systemic radioactive isotopes.

Radiation therapy and chemotherapy via local delivery of radioconjugates and chemotherapeutics, may also be used in the methods described herein. Directing the cytotoxic exposure directly to the tumor itself is a commonly used approach to deliver a cytotoxic drug while minimizing the cytotoxic exposure of normal tissues. However, one of the factors which limit the effectiveness of such an approach is incomplete induction of tumor cell death because of limited dose delivery. Thus, it would be highly desirable to concurrently use the variant-HSV containing therapeutics of the invention to enhance the sensitivity of the tumor cells to the particular cytotoxic agent. Tumor-specific delivery is commonly achieved by conjugating a cytotoxic agent (e.g., a toxin (such as ricin) or a radioisotope) to an antibody that preferentially targets the tumor (e.g., glypican-3 in hepatocellular carcinoma, anti-CD2 in neuroblastoma, or anti-Her2-neu in certain breast carcinomas. The targeting may be also done with natural targeting (i.e., with radioactive iodine in the treatment of thyroid carcinoma), physical targeting (i.e., administration of a radioisotope to a particular body cavity), or other targeting polypeptide (e.g., ferritin in hepatocellular carcinoma).

In addition to combination with conventional cancer therapies such as chemotherapy, radiation therapy, thermotherapy, surgery (tumor resection), TACE (transarterial chemoembolization), variant-HSV oncolytic therapy in tumor or cancer cells can be combined with other anti-tumor/anti-cancer therapies, including but by no means limited to small tyrosine kinase inhibitors (e.g., sorafenib, erlotinib, gefitinib, brivanib, sunitinib, lapatinib, cediranib, vatalanib), monoclonal antibodies (e.g. cetuximab, bevacizumab, IMC-A12, IMC1121B, panitumumab, trastuzumab), suicide gene therapy (i.e., introduction of genes that encode enzymes capable of conferring to tumor cells sensitivity to chemotherapeutic agents such as thymidine kinase of herpes simplex virus or varicella zoster virus and bacterial cytosine deaminase), anti-oncogene or tumor suppressor gene therapy (e.g., using anti-oncogene molecules including monoclonal antibodies, single chain antibody vectors, anti-sense oligonucleotide constructs, ribozymes, immunogenic peptides, etc.), administration of tumor growth inhibitors (e.g., interferon (IFN)-γ, tumor necrosis factor (TNF)-α, TNF-β, and similar cytokines, antagonists of tumor growth factor (TGF)-β and IL-10, etc.), administration of angiogenesis inhibitors (e.g., fragments of angiogenic polypeptides that are inhibitory [such as the ATF of urokinase], angiogenesis inhibitory factors [such as angiostatin and endostatin], tissue inhibitors of metalloproteinase, soluble receptors of angiogenic factors [such as the urokinase receptor or FGF/VEGF receptor], molecules which block endothelial cell growth factor receptors, and Tie-1 or Tie-2 inhibitors), vasoconstrictive agents (e.g., nitric oxide inhibitors), immune therapies with an immunologically active polypeptide (including immunostimulation, e.g., in which the active polypeptide is a cytokine, lymphokine, or chemokine [e.g., IL-2, GM-CSF, IL-12, IL-4], and vaccination, in which the active polypeptide is a tumor specific or tumor associated antigen), and any other small molecules useful for treating cancer including pro-apoptotic agents (e.g. mapatumumab), proteosome inhibitors (e.g. bortezomib), cell cycle inhibitors (e.g. flavopiridol), DNA methylation inhibitors (e.g. 5-Aza-cytidine) and the like.

Tumor load is assessed prior to therapy by means of objective scans of the tumor such as with x-ray radiographs, computerized tomography (CAT scans), nuclear magnetic resonance (NMR) scans or direct physical palpation of the tumor mass. Alternatively, the tumor may secrete a marker substance such as alphafetoprotein from colon cancer, CA 125 antigen from ovarian cancer, or serum myeloma "M" protein from multiple myeloma, or AFP for hepatocellular carcinoma. The levels of these secreted products then allow for an estimate of tumor burden to be calculated. These direct and indirect measures of the tumor load are done pretherapy, and are then repeated at intervals following the administration of the drug in order to gauge whether or not an objective response has been obtained. An objective response in cancer therapy generally indicates >50% shrinkage of the measurable tumor disease (a partial response), or complete disappearance of all measurable disease (a complete response). Typically these responses must be maintained for a certain time period, usually one month, to be classified as a true partial or complete response. In addition, there may be stabilization of the rapid growth of a tumor or there may be tumor shrinkage that is <50%, termed a minor response or stable disease.

In general, increased survival is associated with obtaining a complete response to therapy and, in some cases, a partial response if maintained for prolonged periods can also contribute to enhanced survival in the patient. Patients receiving chemotherapy are also typically "staged" as to the extent of their disease before and following chemotherapy are then restaged to see if this disease extent has changed. In some situations the tumor may shrink sufficiently and if no metastases are present, then surgical excision may be possible after chemotherapy treatment where it was not possible beforehand due to the widespread disease. In this case the chemotherapy treatment with the novel pharmaceutical compositions of the invention is being used as an adjuvant to potentially curative surgery. In addition, patients may have individual lesions in the spine or elsewhere that produce symptomatic problems such as pain and these may need to have local radiotherapy applied. This may be done in addition to the continued use of the systemic pharmaceutical compositions.

Patients are assessed for toxicity with each course of administration of a variant HSV of the invention or composition comprising a variant HSV, typically looking at effects on liver function enzymes and renal function enzymes such as creatinine clearance or BUN as well as effects on the bone marrow, typically a suppression of granulocytes important for fighting infection and/or a suppression of platelets important for hemostasis or stopping blood flow. For such assessments, normal blood counts may be reached between 1-3 weeks after therapy. Recovery then ensues over the next 1-2 weeks. Based on the recovery of normal white blood counts, treatments may then be resumed.

Typically, complete and partial responses are associated with at least a 1-2 log reduction in the number of tumor cells (a 90-99% effective therapy), although smaller or larger reductions in tumor burden are also possible. Patients with advanced cancer will typically have >$10^9$ tumor cells at diagnosis, multiple treatments may be required in order to reduce tumor burden to a very low state and potentially obtain a cure of the disease.

At the end of a treatment cycle with a pharmaceutical formulation of the invention, which could comprise several weeks of continuous drug dosing, patients can be evaluated for response to therapy (complete and partial remissions), toxicity measured by blood work and general well-being classified performance status or quality of life analysis. The latter includes the general activity level of the patient and their ability to do normal daily functions. It has been found to be a strong predictor of response and some anticancer drugs may actually improve performance status and a general sense of well-being without causing significant tumor shrinkage. Thus, for some cancers that are not curable, the pharmaceutical formulations may similarly provide a significant benefit, well-being performance status, etc. without affecting true complete or partial remission of the disease.

A number of biological assays are available to evaluate and to optimize the choice of variant HSV and compositions comprising variant HSV for optimal antitumor/anticancer activity. These assays can be roughly split into two groups; those involving in vitro exposure of variant HSV to tumor/cancer cells and in vivo antitumor/anticancer assays in rodent models and rarely, in larger animals.

Cytolytic assays in vitro for variant HSV generally involve the use of established tumor/cancer cell lines both of animal and of human origin. These cell lines can be obtained from commercial sources such as the American Type Tissue Culture Laboratory in Bethesda, Md., and from tumor/cancer cell banks at research institutions. Exposures to variant HSV may be carried out under simulated physiological conditions of temperature, oxygen and nutrient availability in the laboratory. The endpoints for these in vitro assays can involve: 1) colony formation; 2) a simple quantitation of cell division over time; 3) the uptake of so called "vital" dyes which are excluded from cells with an intact cytoplasmic membrane; 4) the incorporation of radiolabeled nutrients into a proliferating (viable) cell. Colony forming assays have been used both with established cell lines, as well as fresh tumor biopsies surgically removed from patients with cancer. In this type of assay, cells are typically grown in petri dishes on soft agar, and the number of colonies or groups of cells (>60 m in size) are counted either visually, or with an automated image analysis system. A comparison is then made to the untreated control cells allowed to develop colonies under identical conditions.

Because colony formation is one of the hallmarks of the cancer phenotype, only malignant cells will form colonies without adherence to a solid matrix. This can therefore be used as a screening procedure and assay for effectiveness for variant HSV, and there are a number of publications which show that results obtained in colony forming assays correlate with clinical trial findings with the same drugs.

The enumeration of the total number of cells is one approach to in vitro testing with either cell lines or fresh tumor biopsies. In this assay, clumps of cells are typically disaggregated into single units which can then be counted either manually on a microscopic grid or using an automated flow system such as either flow cytometry or a Coulter™ counter. Control (untreated) cell growth rates are then compared to the treated (with a nucleic acid) cell growth rates. Vital dye staining is another one of the older hallmarks of antitumor assays. In this type of approach cells either untreated or treated with a cancer drug (e.g., oncolytic variant HSV), are subsequently exposed to a dye such as methylene blue, which is normally excluded from intact (viable) cells. The number of cells taking up the dye (dead or dying) is the numerator with a denominator being the number of cells which exclude the dye.

In addition to vital dye staining, viability can be assessed using the incorporation of radiolabeled nutrients and/or nucleotides. In tumor cell assays, a typical experiment involves the incorporation of either (3H) tritium- or 14C-labeled nucleotides such as thymidine. Control (untreated) cells are shown to take up a substantial amount of this normal DNA building block per unit time, and the rate of incorporation is compared to that in the drug treated cells. This is a rapid and easily quantifiable assay that has the additional advantage of working well for cells that may not form large (countable) colonies. Drawbacks include the use of radioisotopes which present handling and disposal concerns.

There are large banks of human and rodent tumor/cancer cell lines that are available for these types of assays. Examples of suitable cell lines include but are not limited to UMUC3, T24, J82 and EJ (MGH-U1), J82 (CO'T), RT4, RT112, TCCSuP and SCaBER cells, which are bladder cancer cell lines. However, cell lines from other types of cancers (e.g., HT29 colorectal adenocarcinoma, LNCaP-.FGC prostate adenocarcinoma, MDA-MB-231 breast adenocarcinoma, SK-MEL-28 malignant melanoma or U-87 MG) are also suitable. Other examples of suitable melanoma cell lines include without limitation, A-375, HS-695T, IGR-1, MEL-CLS-1, MEL-CL2, MEL-CLS3, MEL-CLS-4, MEWO, MML01, NIS-G, SK-MEL-1, SK-MEL-2 and SK-MEL-5 (available, e.g., from Cell Line Services (Germany). Non-limiting examples of ovarian cancer cell lines, include, e.g., PA-1, Caov-3, SW 626 and SK-OV-3. Non-limiting examples of glioblastoma cell lines include, e.g., LN-18, U-87 MG, F98, T98G. Such cell lines are commercially available, e.g., from American Type Culture Collection (ATCC).

The current test system used by the National Cancer Institute uses a bank of over 60 established sensitive and multidrug-resistant human cells lines of a variety of cell subtypes. This typically involves 5-6 established and well-characterized human tumor/cancer cells of a particular subtype, such as non-small cell or small cell lung cancer, for testing new agents. Using a graphic analysis system called Compare™, the overall sensitivity in terms of dye uptake (either sulforhodamine B or MTT tetrazolium dye) is determined. The specific goal of this approach is to identify nucleic acids that are uniquely active in a single histologic subtype of human cancer. In addition, there are a few sublines of human cancer that demonstrate resistance to multiple agents and are known to, in some cases, express the multidrug resistance pump, p-glycoprotein. The endpoint for certain assays is the incorporation of a protein dye called sulforhodamine B (for adherent tumor cells) and the reduction of a tetrazolium (blue) dye in active mitochondrial enzymes (for non-adherent, freely-floating types of cells).

Once a variant HSV of the invention has demonstrated some degree of activity in vitro at inhibiting tumor/cancer cell growth and/or at killing tumor cells, such as colony formation or dye uptake, antitumor/antitumor efficacy experiments are performed in vivo. Rodent systems can be used for initial assays of antitumor activity since tumor growth rates and survival endpoints are well-defined, and since these animals generally reflect the same types of toxicity and drug metabolism patterns as in humans. For this work, syngeneic (same gene line) tumors are typically harvested from donor animals, disaggregated, counted and then injected back into syngeneic (same strain) host mice. Variant HSV are typically then injected at some later time point(s), preferably by in situ injection into the tumor site. Tumor growth rates and/or survival are determined and compared to untreated controls. In these assays, growth rates are typically measured for tumors growing in the flank of the animal, wherein perpendicular diameters of tumor width are translated into an estimate of total tumor mass or volume. The time to reach a predetermined mass is then compared to the time required for equal tumor growth in the untreated control animals.

In some embodiments, significant findings generally involve a >25% increase in the time to reach the predetermined mass in the treated animals compared to the controls. In other embodiments, significant findings involve a >50% increase in the time to reach the predetermined mass in the treated animals compared to the controls. The significant findings are termed "tumor growth inhibition" or "antitumor response."

Human tumors have been successfully transplanted in a variety of immunologically deficient mouse models. A mouse called the nu/nu or "nude" mouse can be used to develop in vivo assays of human tumor growth. In nude mice, which are typically hairless and lack a functional thymus gland, human tumors (millions of cells) are typically injected in the flank and tumor growth occurs slowly thereafter. This visible development of a palpable tumor mass is called a "take". Anticancer drugs such as the variant HSV disclosed herein are then injected by some route (intravenous, intramuscular, subcutaneous, per os) into or distal to the tumor implant site, and growth rates are calculated by perpendicular measures of the widest tumor widths as described earlier. A number of human tumors are known to successfully "take" in the nude mouse model. An alternative mouse model for this work involves mice with a severe combined immunodeficiency disease (SCID), in which there is a defect in maturation of lymphocytes. Because of this, SCID mice do not produce functional B- and T-lymphocytes. However, these animals do have normal natural killer (NK) cell activity. Nonetheless, SCID mice will "take" a large number of human tumors. Tumor measurements and drug dosing are generally performed as above. Again, positive compounds in the SCID mouse model are those that inhibit tumor growth rate by >20-50% compared to the untreated control.

For in vivo studies, such as for a study for efficacy of a variant HSV of the invention for treating bladder cancer, an orthotopic mouse model can be used which closely mimics bladder cancer in humans. The major utility of orthotopic cancer models is that it allows treatment of a tumor within the bladder and intravesical instillation into the bladder to be evaluated as a mode of therapy. Orthotopic models using human tumor cells can be examined in athymic, immuno-compromised mice, whereas syngenic murine tumors can be utilized in immune competent mice. Transgenic mice that spontaneously develop tumors in the bladder can also be used. As disclosed in the Examples, herein, the variant HSV of the invention are particularly useful because they are capable of inhibiting murine TAP, e.g., by the expression of UL49.5 from BHV, and can thus be studied in immune competent murine models of cancer in which the mice are seropositive for HSV-1, and the ability of the improved variant HSV of the invention to evade the host immune response, and the importance of that immune-evasion capability for anti-tumor function of the variant HSV can be determined. Such models provide important data regarding how effective a variant HSV of the invention will be, e.g., in an immune-competent human subject, such as a cancer patient.

The most commonly used immune competent mouse model for evaluating therapeutics (such as the variant OV provided herein) for the treatment of melanoma utilizes mouse B16F10 cells implanted into C57/B16 mice either s.c. or into organs, such as the brain, in order to initiate tumor formation. The anti-tumor efficacy of the candidate therapeutic is then evaluated by administration to the animal in any number of ways, including e.g., direct injection into the tumor, injection into the mouse vasculature for systemic delivery, or intradermal injection in an area outside the tumor site. Measurement of tumor size, overall animal survival compared to control animals bearing tumors, and induction of immune cells that recognize and kill B16F10 cells can be measured as indicators of therapeutic efficacy. The model described in detail in Zamarin D, et al. *Gene Ther* 2009; 16:796-804, which employed B16F10 cells to evaluate the in vivo efficacy of an OV for the treatment of metastatic melanoma can be used of evaluate the in vivo properties of the OV described herein. The mouse model and methods described in Toda M, et al. *Hum Gene Ther* 1999; 10:385-93, which describes a classical study in the HSV-1OV field that employed DBA/2 mice harboring bilateral s.c. mouse melanoma tumors derived from cultured M3 melanoma cells can also be used. The Toda et al. study demonstrated that HSV-1OV are capable of eliciting an anti-tumor immune response against melanoma cells.

There are a number of mouse ovarian cancer cell lines that are used in immune competent mice to evaluate the efficacy of therapeutics for the treatment of metastatic ovarian cancer. Some common mouse ovarian cancer cell lines are MOSEC cells, ID8-VEGF, and Defb29-VEGF [see, Chalikonda S, et al. Cancer Gene Ther 2008; 15:115-25; Benencia F, et al. *Cancer Biology & Therapy* 2008; 7:1194-205; and Hung C F, et al. *Gene Ther* 2007; 14:20-9]. Metastatic ovarian cancer usually presents as metastatic foci lining the peritoneal cavity. Therefore, most models involve intraperitoneal injection of cultured mouse ovarian cancer cells in order to establish metastatic ovarian cancer lesions lining the peritoneal cavity. OV, e.g., the recombinant OV described herein, can then be instilled into the peritoneal cavity to facilitate infection of all tumors accessible to the virus. As with bladder and melanoma models, OV therapeutic efficacy can be measured by monitoring tumor size over time and overall animal survival compared to control animals bearing tumors, as well as induction of immune cells that recognize and kill the cancer cells.

4C8 and 203GL mouse glioblastoma cell lines can be used in immune competent mice to evaluate the efficacy of therapeutics for the treatment of glioblastoma [see, Hellums E K, et al. *Neuro-oncology* 2005; 7:213-24; Markert J M, et al. *J Virol* 2012; 86:5304-13; and Todo T, et al. *Hum Gene Ther* 1999; 10:2741-55]. Mouse glioblastoma models typically, although not necessarily, employ orthotopic tumors established by drilling a burr hole through the mouse cranium, then injecting cultured mouse glioma cells into the frontal lobes and closing the wound with a suture. At a predetermined time point after intracranial tumor implantation, the burr holes are reopened and OV are directly injected into the tumor. Overall animal survival compared to control animals bearing tumors can be used as a measure of the efficacy of the therapy, since tumor size can typically only be measured post-mortem. Examples of murine models of glioma are described, e.g., in Bruggeman et al. 2007; Cancer Cell; 12(4):328-341; and Marumoto T, et al. *Nat. Med.* 2009 15(1):110-6.

All of these test systems are generally combined in a serial order, moving from in vitro to in vivo, to characterize the antitumor activity of an oncolytic variant HSV of the invention. In general, one wishes to find out what tumor types are particularly sensitive to a variant HSV and conversely what tumor types are intrinsically resistant (e.g., non-permissive) to a variant HSV in vitro. Using this information, experiments are then planned in rodent models to evaluate whether or not the variant HSV that have shown activity in vitro will be tolerated and active in animals. The initial experiments in animals generally involve toxicity testing to determine a tolerable dose schedule and then using that dose schedule, to evaluate antitumor efficacy as described above. Active variant HSV from these two types of assays may then be tested in human tumors growing in SCID or nude mice and if activity is confirmed, these variant HSV then become candidates for potential clinical drug development.

Administration

The variant HSV of the invention or compositions, e.g., pharmaceutical compositions, comprising the variant HSV, may be administered to an individual, e.g., patient, preferably a human patient, in need of treatment. A subject or patient in need of treatment is an individual suffering from cancer, preferably an individual with a solid tumor, and preferably is one who would benefit by the administration of the variant HSV or pharmaceutical composition thereof. The aim of therapeutic treatment is to improve the condition of a patient. Typically, although not necessarily, therapeutic treatment using a variant HSV or pharmaceutical composition of the invention alleviates the symptoms of the cancer. A method of treatment of cancer according to the invention comprises administering a therapeutically effective amount of a variant HSV of the invention or of a pharmaceutical composition containing the variant HSV to a patient suffering from cancer. Administration of an oncolytic variant HSV or composition of the invention to an individual suffering from a tumor will typically kill the cells of the tumor, thus decreasing the size of the tumor and/or reducing or preventing spread of malignant cells from the tumor.

A variant HSV or pharmaceutical composition thereof can be introduced parenterally, transmucosally, e.g., orally (per os), nasally, or rectally, or transdermally. Parental routes include intravenous, intra-arteriole, intra-muscular, intradermal, subcutaneous, intraperitoneal, intraventricular, and intracranial administration. For example, a variant HSV-containing composition can be administered by injection, infusion, instillation or inhalation. A preferred route of administration is by direct injection. For example, therapeutic treatment may be carried out following direct injection of the variant HSV composition into target tissue (i.e., "in situ administration"). The target tissue may be the tumor or a blood vessel supplying the tumor.

A variant HSV-containing compositions may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in oily or aqueous vehicles, and may contain formulatory agents such as suspending, stabilizing and/or dispersing agents.

In addition to the formulations described previously, variant HSV-containing compositions may also be formulated as a depot preparation. Such long acting formulations may be administered by implantation (for example subcutaneously or intramuscularly) or by intramuscular injection. Thus, for example, the variant HSV-containing compositions may be formulated with suitable polymeric or hydrophobic materials (for example, as an emulsion in an acceptable oil) or ion exchange resins, or as sparingly soluble derivatives, for example, as a sparingly soluble salt. In yet another embodiment, the therapeutic compound can be delivered in a controlled release system. For example, a variant HSV may be administered using intravenous infusion with a continuous pump, in a polymer matrix such as poly-lactic/glutamic acid (PLGA), a pellet containing a mixture of cholesterol and the active ingredient (Silastic®; Dow Corning, Midland, Mich.; see U.S. Pat. No. 5,554,601) implanted subcutaneously, an implantable osmotic pump, a transdermal patch, liposomes, or other modes of administration. In another embodiment, the active ingredient can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss: New York, pp. 353-365 (1989); Lopez-Berestein, ibid., pp. 317-327; see generally ibid.).

The routes of administration and dosages described are intended only as a guide since a skilled practitioner will be able to determine readily the optimum route of administration and dosage. The dosage may be determined according to various parameters, especially according to the location of the tumor, the size of the tumor, the age, weight and condition of the patient to be treated and the route of administration. Preferably the virus is administered by direct injection into the tumor. The virus may also be administered systemically or by injection into a blood vessel supplying the tumor. The optimum route of administration will depend on the location and size of the tumor.

Administration of a variant HSV-containing composition may be once a day, twice a day, or more often, but frequency may be decreased during a maintenance phase of the disease or disorder, e.g., once every second or third day instead of every day or twice a day. The dose and the administration frequency will depend on the clinical signs, which confirm maintenance of the remission phase, with the reduction or absence of at least one or more preferably more than one clinical signs of the acute phase known to the person skilled in the art. More generally, dose and frequency will depend in part on recession of pathological signs and clinical and subclinical symptoms of a disease condition or disorder contemplated for treatment with the present compounds.

Keeping the above description in mind, the amount of virus administered in the case of HSV can be in the range of from $10^4$ to $10^{10}$ pfu, preferably from $10^5$ to $10^8$ pfu, more preferably about $10^6$ to $10^9$ pfu. Typically 1-4 ml, such as 2 to 3 ml of a pharmaceutical composition consisting essentially of the virus and a pharmaceutically acceptable suitable carrier or diluent would be used for direct injection into an individual tumor. [See, Senzer et al. J Clin Oncol (2009) 27(34):5763-5771.] However for some oncolytic therapy applications larger volumes up to 10 ml may also be used, depending on the tumor type, tumor size and the inoculation site. Likewise, smaller volumes of less than 1 ml may also be used. Dosages and administration regimen can be adjusted depending on the age, sex and physical condition of the subject or patient as well as the benefit of the treatment and side effects in the patient or mammalian subject to be treated and the judgment of the physician, as is appreciated by those skilled in the art.

The present invention is described here by means of the following examples. However, the use of examples anywhere in the specification is illustrative of and in no way limits the scope and meaning of the invention or of any exemplified terms. Likewise, the invention is not limited to any particular embodiment described herein. Indeed, many modifications and variations to those skilled in the art upon reading this specification and can be made without departing from its spirit and scope. The invention is therefore to be limited only by the terms of the appended claims along with the full scope of equivalents to which the claims are entitled. The disclosures of all citations, including issued patents, published applications, and scientific articles, in the specification are expressly incorporated herein by reference in their entirety.

It is to be understood that numerical values of binding activities and other parameters reported in the examples, and throughout the entire specification, are approximate. Individual measurements of these parameters may vary, e.g., due to normal experimental error and/or depending on the specific conditions used.

In accordance with the present invention there may be employed conventional molecular biology, microbiology, and recombinant DNA techniques within the skill of the art. Such techniques are explained fully in the literature. See, e.g., Sambrook, Fritsch & Maniatis, Molecular Cloning: A Laboratory Manual, Second Edition. Cold Spring Harbor, N.Y.: Cold Spring Harbor Laboratory Press, 1989 (herein "Sambrook et al., 1989"); DNA Cloning: A Practical Approach, Volumes I and II (D. N. Glover ed. 1985); Oligonucleotide Synthesis (M. J. Gait ed. 1984); Nucleic Acid Hybridization [B. D. Hames & S. J. Higgins eds. (1985)]; Transcription And Translation [B. D. Hames & S. J. Higgins, eds. (1984)]; Animal Cell Culture [R. I. Freshney, ed. (1986)]; Immobilized Cells And Enzymes [IRL Press, (1986)]; B. Perbal, A Practical Guide To Molecular Cloning (1984); Ausubel, F. M. et al. (eds.). Current Protocols in Molecular Biology. John Wiley & Sons, Inc., 1994. These techniques include site directed mutagenesis as described in Kunkel, Proc. Natl. Acad. Sci. USA 82: 488-492 (1985), U.S. Pat. No. 5,071,743, Fukuoka et al., Biochem. Biophys. Res. Commun 263: 357-360 (1999); Kim and Maas, BioTech. 28: 196-198 (2000); Parikh and Guengerich, BioTech. 24: 4 28-431 (1998); Ray and Nickoloff, BioTech. 13: 342-346 (1992); Wang et al., BioTech. 19: 556-559 (1995); Wang and Malcolm, BioTech. 26: 680-682 (1999); Xu and Gong, BioTech. 26: 639-641 (1999), U.S. Pat. Nos. 5,789,166 and 5,932,419, Hogrefe, Strategies 14. 3: 74-75 (2001), U.S. Pat. Nos. 5,702,931, 5,780,270, and 6,242,222, Angag and Schutz, Biotech. 30: 486-488 (2001), Wang and Wilkinson, Biotech. 29: 976-978 (2000), Kang et al., Biotech. 20: 44-46 (1996), Ogel and McPherson, Protein Engineer. 5: 467-468 (1992), Kirsch and Joly, Nuc. Acids. Res. 26: 1848-1850 (1998), Rhem and Hancock, J. Bacteriol. 178: 3346-3349 (1996), Boles and Miogsa, Curr. Genet. 28: 197-198 (1995), Barrenttino et al., Nuc. Acids. Res. 22: 541-542 (1993), Tessier and Thomas, Meths. Molec. Biol. 57: 229-237, and Pons et al., Meth. Molec. Biol. 67: 209-218.

EXAMPLES

Example 1

Genetic Properties of HSV-1 and Oncolytic Strains Thereof

This Example describes the genetic construction of a neuro-attenuated variant HSV (strain Patton) having intact endogenous $U_S12$ and $U_S11$, in which the $\gamma_134.5$ genes are replaced with $U_S11$ fused to an immediate early (IE) promoter, The HSV-1 genome comprises two unique genome segments, referred to as the Unique-long ($U_L$) and Unique-short ($U_S$) segments. Both the $U_L$ and $U_S$ sequences are flanked by inverted terminal repeats, illustrated as empty rectangles in FIGS. 1A-1C. In the wild-type HSV (FIG. 1A) the $\gamma_134.5$ gene, which confers neurovirulence, is a diploid element located within the inverted repeats flanking the $U_L$ segment. The location and arrangement of the $U_S11$ and $U_S12$ genes are indicated and expanded below the HSV-1 genome in FIG. 1A. The $U_S12$ gene is expressed very early during infection by an immediate early promoter (denoted by star-12 in FIG. 1A). The $U_S11$ gene is expressed late in viral infection by a separate promoter (denoted by star-11 in FIG. 1A) that is contained within the $U_S12$ gene.

In the modified HSV-1 OncoVex$^{GMCSF}$ (FIG. 1B), the $\gamma_134.5$ genes are replaced by the CMV promoter, fused to the gene encoding human Granulocyte-Macrophage Colony Stimulating Factor or "GM-CSF". Deletion of $\gamma_134.5$ results in neuro-attenuation, but it also results in a severe reduction in the ability of the virus to overcome a cellular block to viral replication during infection of many cancer cell lines. To overcome this deficiency, $U_S12$ is deleted in order to direct synthesis of $U_S11$ from the immediate early $U_S12$ promoter, resulting in $U_S11$ accumulation prior to the crippling protein synthesis block. However, while this maximizes protein synthesis during infection, loss of $U_S12$ results in a viral inability to evade CD8+ cytolytic T-cell killing of infected cells, leading to enhanced viral clearance, decreased cell killing by the virus, and reduced overall synthesis of GM-CSF.

In order to address the deficiencies in OncoVEX$^{GMSCF}$, a neuro-attenuated variant HSV (strain Patton) having intact endogenous Us12 and Us11, in which the $\gamma_134.5$ genes are replaced with $U_S11$ fused to an immediate early (IE) promoter, was generated, as described in detail in U.S. Pat. No. 7,731,952.

To generate an avirulent Δ34.5 virus that expresses Us11 at immediate early (IE) times and preserves the immunomodulatory Us12 gene, both the $\gamma_134.5$ promoter and ORF of the HSV-1 genome were replaced by cloning the Us11 gene, under transcriptional control of the α27 IE promoter, between the DraI and SacI sites of Bam SP, as shown in FIG. 1C. This fragment was cotransfected into Vero cells with purified Δ34.5 virus DNA and recombinants were selected on U251 glioblastoma cells which are non-permissive for the growth of Δ34.5 viruses that do not express Us11 at IE times. This modified virus was named: Δ34.5::fIα27P-Us11 ("OV-2711"). FIG. 1C is a detailed map of the genome of OV-2711, including restriction sites, and shows the location of the Us11 genes that have replaced the two WT $\gamma_134.5$ genes, while leaving intact the Us11 and Us12 loci. Thus, the modified OV-2711 variant HSV, which is the basis for the novel, improved variant HSV of the present invention, has three functional Us11 genes, as shown in the simplified line diagram in FIG. 1C.

The OV-2711 construct directs synthesis of Us11 throughout the entire viral lifecycle, from both the ectopic IE promoter as well as the endogenous late promoter (denoted by star-11 in FIG. 1), located within the Us12 gene, leading to better viral yields and improved oncolysis.

Example 2

Oncolytic Variant HSV Optimized for Immune-Competent Murine Model

This Example describes improved variant HSV that can be generated based on the OV-2711 HSV described in Example 1, and that can be tested in an immune-competent murine model of cancer.

IE-Us11 is a very powerful dominant selectable marker when inserted into Δ34.5 HSV-1. To isolate a variant HSV containing IE-Us11, the Us11 gene is fused to the HSV-1 IE promoter α27 and this expression cassette is inserted into a targeting vector in place of $\gamma_134.5$ (see, U.S. Pat. No. 7,731,952). Specifically, the targeting vector is the viral BamSP fragment cloned into plasmid pBR322 (Invitrogen, Carlsbad, Calif.). The IE-Us11 cassette is cloned into BamSP between the DraI site upstream of the 34.5 ORF and the second SacI site, downstream of the 34.5 ORF, in order to replace the 34.5 ORF. Flanking the α27-Us11 expression cassette are sequences that mediate homologous recombination into the $\gamma_134.5$ locus. Specifically, a SacI-BamHI fragment that is downstream of the 34.5 ORF and the DraI-BamH1 fragment that is upstream of the 34.5 ORF in the BamSP fragment.

There are two SacI-BamHI fragments in the HSV locus. The first Sac1-BamHI fragment has the following sequence in the HSV-1 strain 17 sequence (GenBank Accession No. X14112 (SEQ ID NO: 1)), occurring at nucleotides 1307-2910:

```
                                        (SEQ ID NO: 12)
ccgcaccaagccgctctccggagagacgatggcaggagccgcgcatatat acgcttggagccagcccgccctcacagggcgggccgcctcggggcggga ctggccaatcggcggccgccagcgcggcggggcccggccaaccagcgtcc gccgagtcttcggggcccggcccattgggcgggagttaccgcccaatggg ccgggccgcccacttcccggtatggtaattaaaaacttgcaagaggcctt gttccgcttcccggtatggtaattagaaactcattaatgggcggccccgg ccgcccttcccgcttccggcaattcccgcggcccttaatgggcaacccg gtattccccgcctcccgcgccgcgcgtaaccactcccctgggttccggg ttatgctaattgctatttggcggaacacacggccctcgcgcattggccc gcgggtcgctcaatgaacccgcattggtccctgggggttccgggtatggt aatgagtttcttcggggaaggcgggaagccccggggcaccgacgcaggca agccctgttgcgtcggcgggaggggcatgctaatgggggttcttttgggggg acaccggggtttgggccccccaaatcggggggccgggccgtgcatgctaatgat
```

-continued

```
attctttgggggcgccgggttggtccccggggacggggccgccccgcggt gggcctgcctcccctgggacgcgcggccattgggggaatcgtcactgccg cccctttggggagggaaaggcgtggggtataagttagccctggcccgac agtctggtcgcatttgcacctcggcactcggagcgagacgcagcagccag gcagactcgggccgcccctctccgcatcaccacagaagcccgcctacg ttgcgaccccagggaccctccgtccgcgaccctccagccgcatacgacc cccatggagcccgccccggagcgagtacccgccggcctgagggccgccc ccagcgcgaggtgaggggccgggcgccatgtctgggcgccatattgggg ggcgccatattgggggcgccatgttgggggaccccgacccttacactg gaaccggccgccatgttgggggaccccactcatacacgggagccgggcg ccatgttgggcgccatgttaggggcgtggaacccgtgacactatata tacagggaccggggcgccatgttaggggtgcggaaccccctgacccta tatatacagggaccggggtcgccctgttgggggtcgccatgtgaccccct gactttatatatacagaccccaacacatacacatggccctttgactca gacgcagggcccggggtcgccgtgggacccctgactcatacacagagac acgccccacaacaaacacacaaggaccggggtcgccgtgttggggcgt ggtccccactgactcatacgcaggcccccttactcacacgcatctaggg gggtggggaggagccgcccgccatatttggggacgccgtgggacccccg actccggtgcgtctggagggcgggagaagagggaagaaagagggtcggga tcc.
```

The second SacI-BamHI fragment has the following sequence in the HSV-1 strain 17 sequence (GenBank Accession No. X14112) (SEQ ID NO: 1)), occurring at nucleotides 123461-125064:

```
                                        (SEQ ID NO: 13)
ggatcccgacccctcttcttccctcttctcccgccctccagacgcaccgg agtcgggggtcccacggcgtcccccaaatatggcgggcggctcctcccca cccccctagatgcgtgtgagtaaggggggcctgcgtatgagtcagtgggg accacgcccccaacacggcgacccccggtccttgtgtgatgttgtgggggc gtgtctctgtgtatgagtcaggggtcccacggcgaccccgggcctgcg tctgagtcaaaggggccatgtgtatgtgttgggggtctgtatatataaag tcaggggtcacatggcgaccccaacagggcgacccggtccctgtata tatagggtcagggggttccgcacccctaacatggcgccccggtccctg tatatatagtgtcacggggttccacgcccctaacatggcgccccaacat ggcgccggctccgtgtatgagtgggggtccccaacatggcggccggt tccagtgtaagggtcggggtcccccaacatggcgcccccaatatggcg cccccaatatggcgcccagacatggcgcccggcccctcacctcgcgct gggggcggccctcaggccggcgggtactcgctccggggcggggctccatg ggggtcgtatgcggctggaaggtcgcggacggagggtccctgggggtcgc aacgtaggcggggcttctgtggtgatgcggagaggggcggcccgagtct gcctggctgctgcgtctcgctccgagtgccgaggtgcaaatgcgaccaga
```

```
ctgtcgggccagggctaacttataccccacgcctttcccctcccaaagg ggcggcagtgacgattcccccaatgccgcgcgtcccaggggaggcaggc ccaccgcggggcggccccgtccccggggaccaacccggcgcccccaaaga atatcattagcatgcacggcccggcccccgatttggggggcccaaccccggt gtccccaaagaacccccattagcatgcccctcccgccgacgcaacagggg cttggcctgcgtcggtgccccggggcttcccgccttcccgaagaaactca ttaccatacccggaaccccaggggaccaatgcgggttcattgagcgaccc gcgggccaatgcgcgaggggccgtgtgttccgccaaaaaagcaattagca taacccggaaccccaggggagtggttacgcgcggcgcggaggcggggaa taccggggttgcccattaagggccgcgggaattgccggaagcgggaaggg cggccggggccgcccattaatgagtttctaattaccataccgggaagcgg aacaaggcctcttgcaagtattaattaccataccgggaagtgggcggccc ggcccattgggcggtaactcccgcccaatgggccgggccccgaagactcg gcggacgctggttggccgggccccgccgcgctggcggccgccgattggcc agtcccgccccgaggcggcccgccctgtgagggcgggctggctccaagc gtatatatgcgcggctcctgccatcgtctctccggagagcggcttggtgc gg.
```

The DraI-BamHI fragment, having a single location in HSV, has the following sequence in the HSV-1 strain 17 sequence (GenBank Accession No. X14112 (SEQ ID NO: 1)), found in nucleotides 125990-129564:

```
                                        (SEQ ID NO: 14)
aaagggccgcgcgcgaccccgggggtgtgttttggggggggcccgttt tcggcgtctggccgctcctccccccgctcctcccccgctcctccccccg ctcctccccccgctcctccccccgctcctccccccgctcctccccccgct cctccccccgctcctccccccgctcctccccccgctcctccccccgctcc tccccccgctcctccccccgctcctccccccgctcctccccccgctcctc ccccccgctcctccccccgctcctccccccgctcccgcggccccgccccc acgcccgccgcgcgcgcacgccgcccggaccgccgcccgcatttttgc gcgcgcgcgcccgcgggggccccgggctgccacaggtgaaaccaacag agcacggcgcactccgcacgtcacacgtcacgtcatccaccacacctgcc caacaacacaactcacagcgacaactcaccgcgcaacaactcctgttcct catccacacgtcaccgcgcacctcccgctcctccagacgtacccggcgc aacacaccgctcctgctacacaccaccgcccctcccagcccagccct ccccagcccagccctcccggcccagccctcccggcccagccctcc ccggcccagccctcccggcccagccctcccggcccagccctcccc ggccccagccctcccggcgcgtcccgcgctcctcggggggttcgggc atctctacctcagtgccgccaatctcaggtcagagatccaaaccctccgg gggcgcccgcgcaccaccaccgccctcgcccctcccgcccctcgcccc ctcccgcccctcgcccctcccgcccctcgcccctcccgcccctcgccc cctcccgcccctcgcccctcccgcccctcgcccctcccgcccctcgcc cctcccgcccctcgcccctcccgcccctcgcccctcccgcccctcgc
```

-continued

```
ccctcccgccctcgcccctcccgccctcgcccctcccgccctcg cccctcccgccctcgcccctcccgccctcgcccctcccgccctc gcccctcccgccctcgcccctcccgccctcgcccctcccgccct cgaataaacaacgctactgcaaaacttaatcaggttgttgccgtttattg cgtcttcgggtctcacaagcgcccgccccgtcccggcccgttacagcac cccgtcccctcgaacgcgccgccgtcgtcttcgtcccaggcgccttccc agtccacaacttcccgccgcgggggcgtggccaagcccgcctccgccccc agcacctccacggccccgccgccgccagcacggtgccgctgcggccgt ggccgaggcccagcgaatcccgggcggcgccggcggcagggcccccgggc cgtcgtcgtcgccgcgcagcaccagcggggggggcgtcgtcgtcgggctcc agcagggcgcgggcgcaaaagtccctccgcgggcccgcgccaccgggccgg gccggcgcgcaccgcctcgcgcccagcgccacgtacacgggccgcagcg gcgcgcccaggccccagcgcgcgcaggcggcgtgcgagtgggcctcctcc tcgcagaagtccggcgcgccgggcgccatggcgtcggtggtccccgaggc cgccgcccggccgtccagcgccggcagcacgggcccggcggtactcgcgcg gggacatgggcaccggcgtgtccgggccgaagcgcgtgcgcacgcggtag cgcacgttgccgccgcggcacaggcgcagcggcggcgtcggggtacag gcgcgcgtgcgcggcctccacgcgcgcgaagaccccgggccgaacacgc ggcccgaggccagcaccgtgcggcgcaggtcccgcgccgccggccagcgc acggcgcactgcacggcgggcagcagctcgcacgccaggtaggcgtgctg ccgcgacaccgcgggcccgtcggcgggccagtcgcaggcgcgcacggtgt tgaccacgatgagccgccggtcgccggcgctggcgagcagcccagaaac tccacgccccggcgaaggccaggtcccgcgtggacagcagcagcacgcc ctgtgcgcccagcgccgacacgtcgggggcgccggtccaattgcccgccc aggcggccgtgtccggcccgcacagccggttggccagggccgccagcagg caggacagcccgccgcgctcggcggaccactccggcggcccccccgaggc cccgccgccggccaggtcctcgcccggcagcggcgagtacagcaccacca cgcgcacgtcctcggggtcggggatctggcgcatccaggccgccatgcgg cgcagcgggcccgaggcgcgcagggggccaaagaggcggccccggcggc cccgtgggggtggggttatcgtcgtcgtcgccgccgccgcacgcggcct gggcggcggggcgggcccggcgcaccgcgcggcgatcgaggccagggcc cgcgggtcaaacatgagggccggtcgccaggggacggggaacagcgggtg gtccgtgagctcggccacggcgcgcggggagcagtaggcctccagggcgg cggccgcgggcgccgccgtgtggctgggcccgggggctgccgccgccag ccgcccaggggtcggggccctcggcgggccggcgcgacacggccacggg gcgcgggcgggcctgccgccgcggcggccggggcgccgcgggctgggcgg gggcgggctcgggccccggggcgtggagggggcgcgggcgcggggagg ggggcgcgggcgtccgagccgggggcgtccgcgccgctcttcttcgtctt cggggggtcgcgggccgccgcctccgggcggccgggccgggccgggactct tgcgcttgcgcccctcccgcggcgcggcggaggcggcggcggccgccagc gcgtcggcggcgtccggtgcgctggccgccgccgccagcaggggggcgcag gctctggttgtcaaacagcaggtccgcggcggcggcggccgcggagctcg gcaggcgcgggtcccgcggcagcgcggggcccagggcccggcgaccagg ctcacggcgcgcacgcggccacggcggcctcgctgccgccggccacgcg caggtccccgcgcaggcgcatgagccacagcgcgtcgcgcacgaaccgca gctcgcgcagccacgcgcgcaggcggggcgcgtcggcgtgcggcggcgc ggggaagcggggcccgcgggtccctccggccgcggggggctggcgggccg ggccccggccagcccgggacggccgccaggtcgccgtcgaagccctcgg ccagcgcctccaggatcccgcggcaggcggccaggcactcgacggccacg cggccggcctgggcgcggcgcccggcgtcgtcgtcggcgtcggcgtggcg ggcggcgtcggggtcgtcgccccccgcggggggaggcgggcgcggcggaca gccgccccagggcggcgaggatcc.
```

This vector is then co-transfected with purified Δ34.5 viral DNA (as described in U.S. Pat. No. 7,731,952) into Vero cells (ATCC No. CCL-81), and IE-Us11 expressing viruses are selected by two passages on U251 cell monolayers. U251 cells [Ren, Y. et al. (2010) *BMC Cancer* 10:27] impose a potent translational block on Δ34.5 viruses, but IE-Us11 expression overcomes this block to viral growth and recombinant IE-Us11 expressing viruses are thus easily selected. Variant HSV are created by inserting expression cassettes encoding UL49.5 and/or murine GM-CSF ("mGM-CSF") under either the CMV or EF1α promoters adjacent to the α27-Us11 dominant selectable marker present in the $\gamma_1 34.5$ locus targeting vector. The insertion of mGM-CSF into the $\gamma_1 34.5$ locus in variant HSV based on OV-2711 (having intact endogenous Us11 and Us12 genes and lacking functional ICP34.5 expression) is expected to create a significantly better biologic for cancer treatment. These constructs are then co-transfected with purified Δ34.5 viral DNA into Vero cells. Recombinants are then selected by passage on U251 cells and plaque purified. Table 1, below, lists examples of the variant HSV that may be created using this robust selection mechanism.

TABLE 1

OV-2711 Variants

| Virus Name | Functions Encoded in Virus | | | |
| --- | --- | --- | --- | --- |
| | Us12 | α27-Us11 | UL49.5 | mGMCSF |
| OV-2711 | + | + | | |
| OV-UL49.5 | + | + | + | |
| OV-UL49.5-fs | + | + | | |
| OV-mGMCSF | + | + | | + |
| OV-UL49.5/mGMCSF | + | + | + | + |

The generation of constructs and isolation of viruses encoding constructs with the functions indicated in Table 1 are described in detail in Example 3, below.

To obtain genetic configurations that allow effective viral growth and synthesis of ectopic proteins, the targeting vector construction strategy illustrated in FIG. 2 is executed. The $\gamma_1 34.5$ locus targeting vector is depicted at the top of the figure. This vector is derived from the viral BamSP fragment, and $\gamma_1 34.5$, located between the DraI and SacI sites of BamSP, is replaced by the α27-Us11 dominant selectable marker. In this process, the SacI site is destroyed and the DraI site replaced by a PacI site.

Figure 3A:
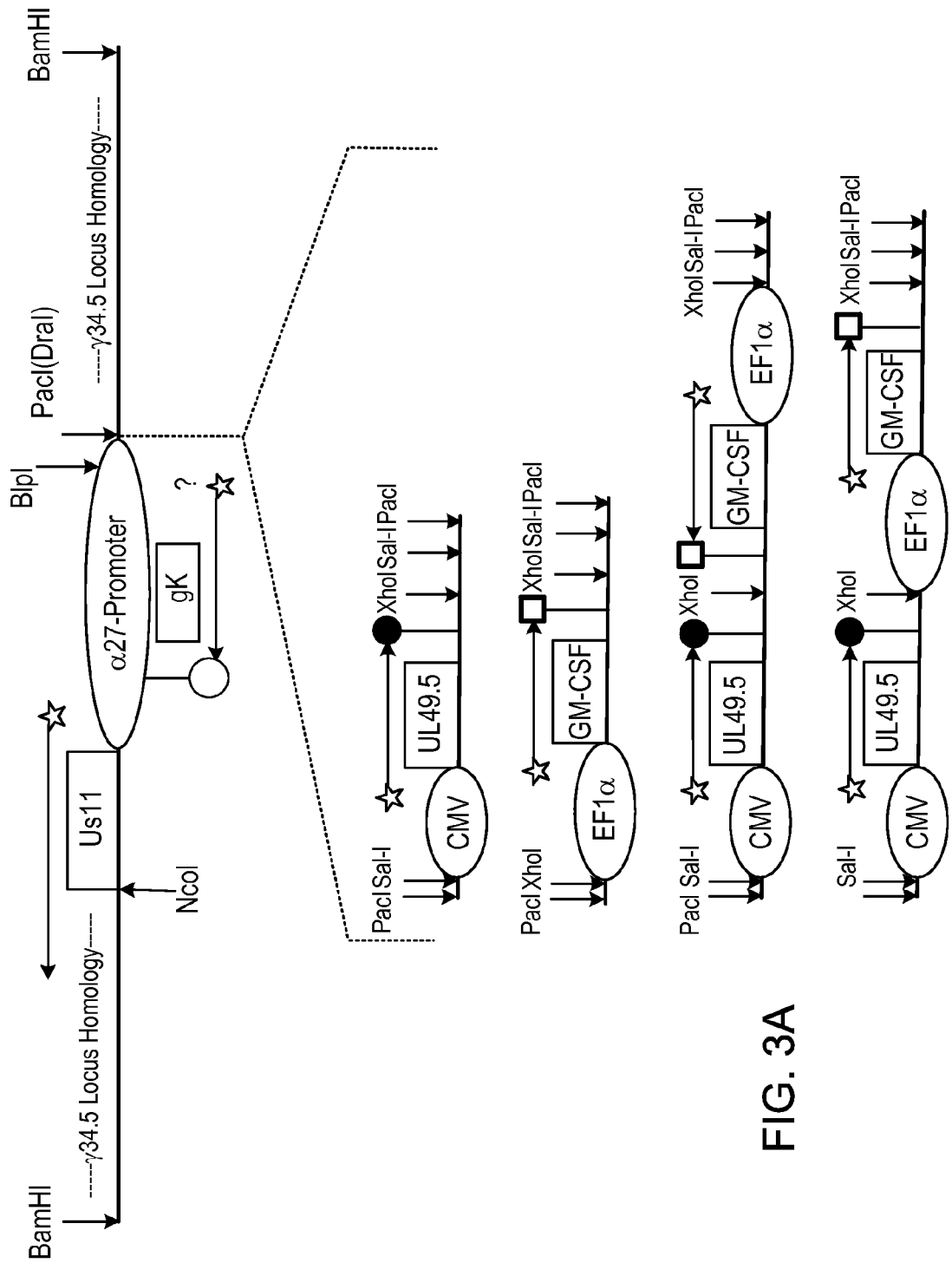
FIGS. 3A-3D illustrate 22 constructs that can be made using the strategy shown in FIG. 2.
Figure 3B:
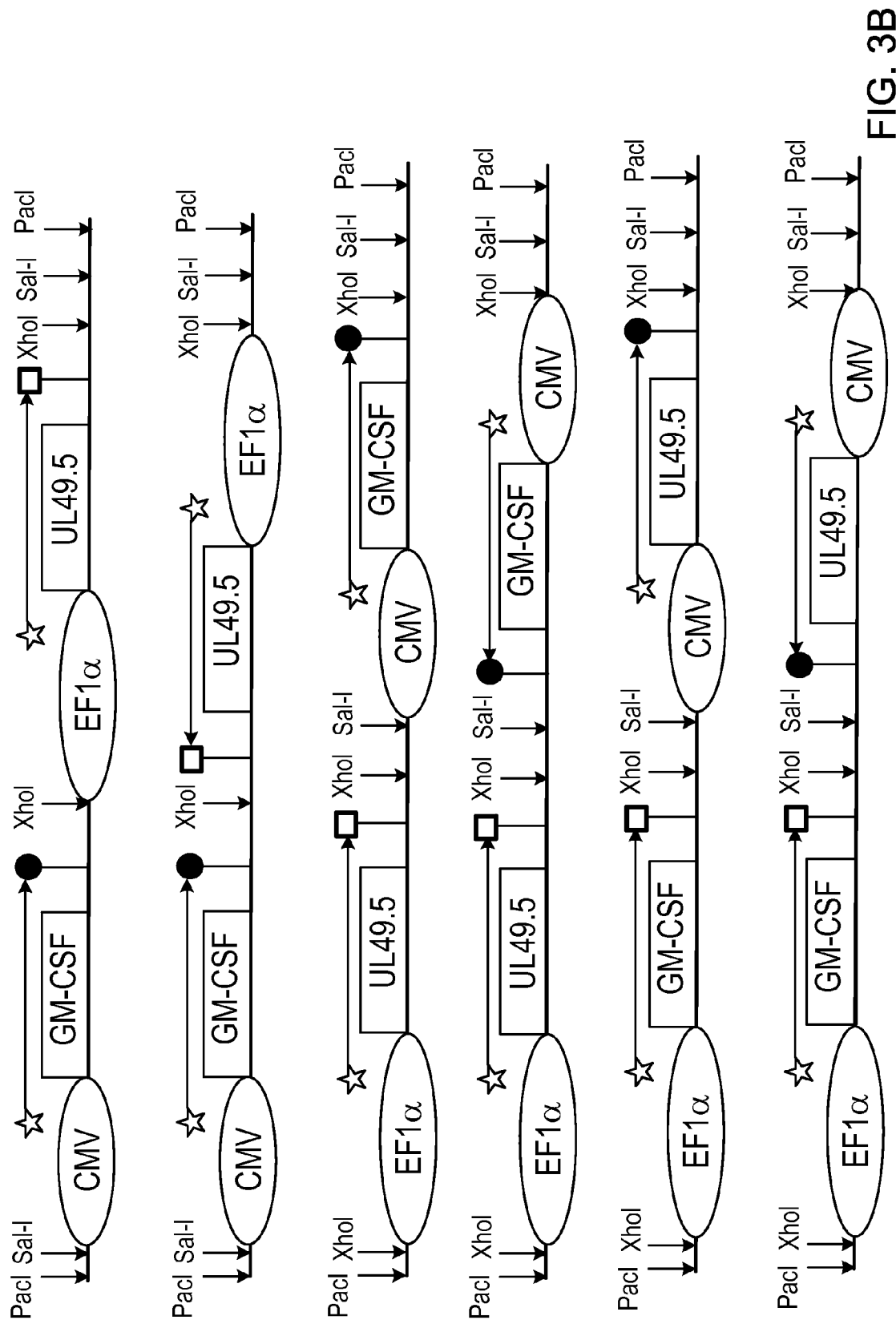
Figure 3C:
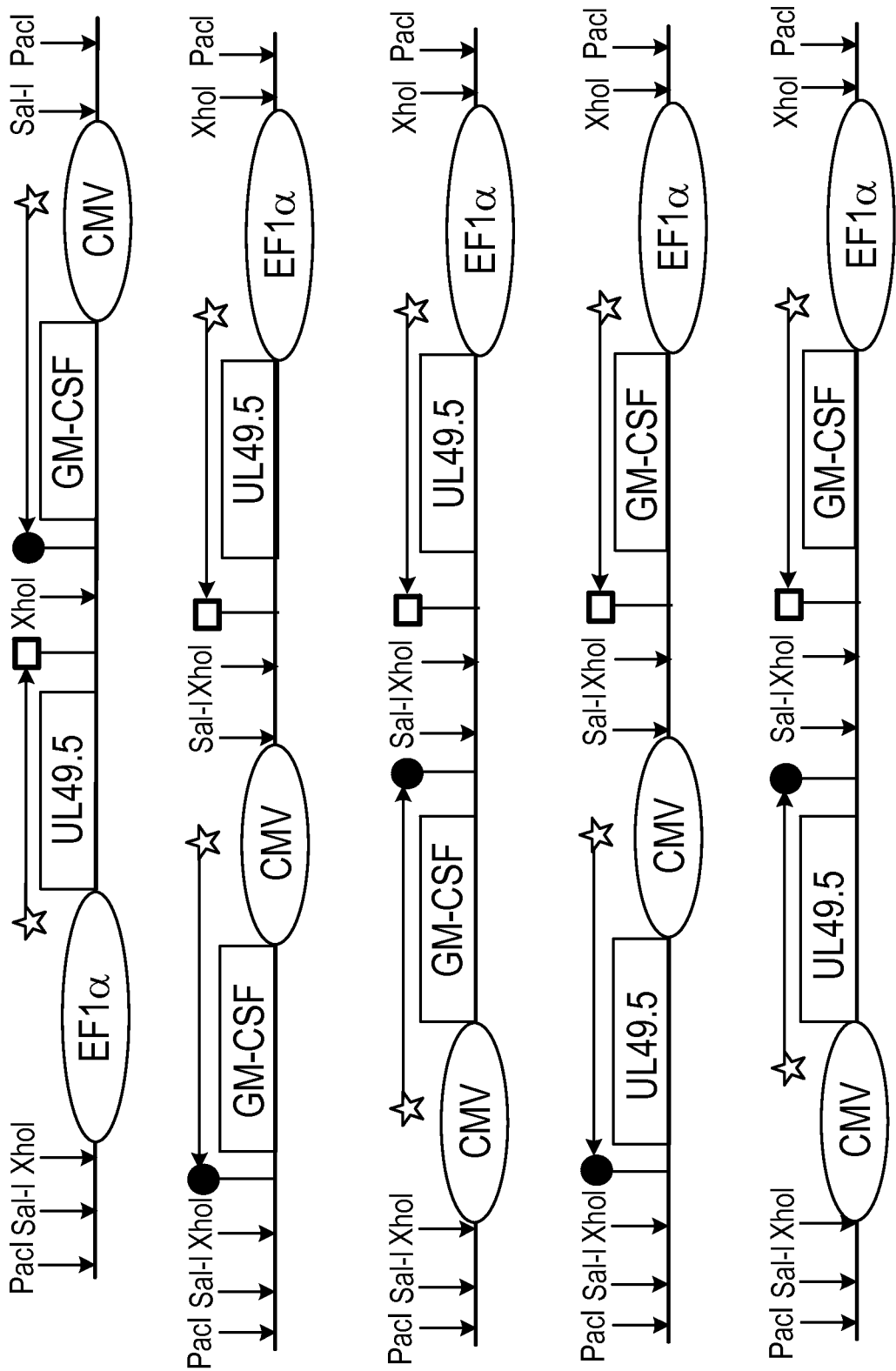
Figure 3D:
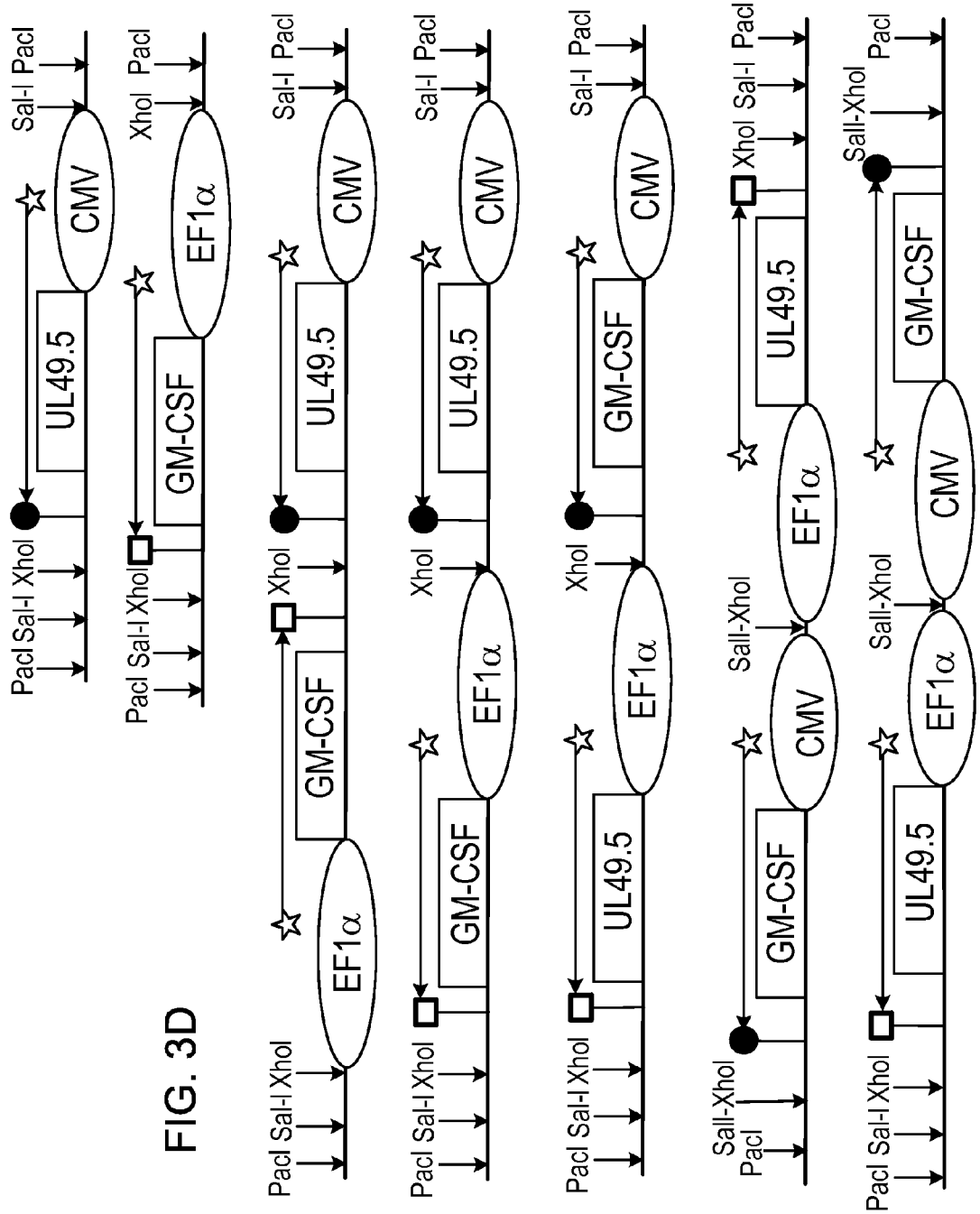

CMV and EF1α promoter cassettes expressing either UL49.5 or GM-CSF flanked by the indicated restriction endonuclease sites (selected from PacI, Sal-I, XhoI, SacI, DraI, BamHI, BlpI) are synthesized de novo (available as a commercial service, e.g., from the contract manufacturer GenScript USA). CMV-based cassettes are terminated by the BGH polyadenylation signal and EF1α terminated by the SV40 late polyadenylation signal. All synthesized cassettes can be inserted into the targeting vector by digestion with PacI followed by ligation and transformation into E. coli. By utilizing one restriction enzyme site, expression cassette insertions in both orientations can be constructed simultaneously. In addition, the placement of the Sal-I and XhoI sites in the synthesized cassettes facilitates facile construction of CMV and EF1α cassette combinations in all possible orientations relative to each other (Sal-I and XhoI have compatible cohesive ends). These combination constructs are then inserted into the PacI site of the targeting vector in both orientations. Execution of this strategy generates 22 targeting constructs, which are shown in FIGS. 3A-3D. As shown in FIGS. 3A-3D, the various transcription cassettes are oriented either in the same direction or run into each other (i.e., have opposite orientations). The last two cassettes shown at the bottom of FIG. 3D illustrate a back-to-back orientation of the CMV and EF1α promoters if partial digestion of a CMV cassette with Sal-I is performed and an XhoI digested EF1α cassette is inserted into the Sal-I site 3' of the CMV promoter. The same construct may be made by partially digesting EF1α cassette with XhoI and inserting a Sal-I digested CMV cassette into the XhoI site 3' of the EF1α promoter.

Internal to α27 promoter fragment in the targeting vector is a copy of the HSV-1 gK gene. The location of the gK gene and the proposed location of the gK promoter are shown in the targeting construct illustrated at the top of FIG. 3A.

An exemplary nucleic acid sequence of the gK gene, is:

```
                                            (SEQ ID NO: 15)
atgctcgccgtccgttccctgcagcacctctcaaccgtcgtcttgataac ggcgtacggcctcgtgctcgtgtggtacaccgtcttcggtgccagtccgc tgcaccgatgtatttacgcggtacgccccaccggcaccaacaacgacacc gccctcgtgtggatgaaaatgaaccagaccctattgtttctgggggcccc gacgcaccccccaacgggggctggcgcaaccacgcccatatctgctacg ccaatcttatcgcgggtagggtcgtgcccttccaggtcccacctgacgcc atgaatcgtcggatcatgaacgtccacgaggcagttaactgtctggagac cctatggtacacacgggtgcgtctggtggtcgtagggtggttcctgtatc tggcgttcgtcgccctccaccaacgccgatgtatgtttggcgtcgtgagt cccgccacaagatggtggcccggccacctacctcttgaactacgcagg ccgcatcgtatcgagcgtgttcctgcagtaccctacacgaaaattaccc gcctgctctgcgagctgtcggtccagcggcaaaacctggttcagttgttt gagacggacccggtcaccttcttgtaccacgcccgccatcggggtcat cgtaggctgcgagttgatgctacgctttgtggccgtgggtctcatcgtcg gcaccgctttcatatccggggggcatgtgcgatcacataccccctgttt ctgaccatcaccacctggtgattgtctccaccatcggcctgacagagctg tattgtattctgcggcggggcccggccccaagaacgcagacaaggccgc
```

-continued
```
cgccccggggcgatccaagggcgtgtcgggcgtctgcgggcgctgctgtt ccatcatcctctcgggcatcgcagtgcgattgtgttatatcgccgtggtg gccggggtggtgctcgtggcgcttcactacgagcaggagatccagaggcg cctgtttgatgtatga.
```

The ATG initiation codon for gK lies approximately 200 bp downstream from the PacI site and is oriented towards Us11. gK is polyadenylated at a polyA signal located upstream of the α27 promoter transcription initiation site. Insertion of gK into the γ₁34.5 locus results in the creation of two additional copies for a total of three gK genes. In certain embodiments, an expression cassette inserted into the PacI site does not interfere with gK expression.

To determine which promoter combinations and orientations yield the best isolates for the viral panel created using the targeting constructs shown in FIGS. 3A-3D, targeting constructs are linearized and co-transformed with purified Δ34.5 viral DNA into Vero cells. The method is described in U.S. Pat. No. 7,731,952. Once viral cytopathic effect (cpe) is observed, the plates are freeze-thawed, viral lysates sonicated, diluted 1:10 and 1:100 and added to confluent monolayers of U251 cells. Once 90% cpe is observed, a second round of U251 selection is performed using 1:100 and 1:1000 dilutions of viral lysate. When 90% cpe is observed at the lowest dilution, plates are freeze-thawed and viral titers determined.

High titer stocks are then prepared by infection of 10 cm dishes containing confluent Vero cell monolayers at a MOI of 0.01. These stocks are then titered and used to infect confluent monolayers of U251 cells at MOI=5. At 16 hrs post-infection, supernatants are removed and stored for ELISA to determine the level of secreted mGM-CSF. Minimal medium containing radioactive cysteine and methionine is then added to label newly synthesized proteins.

The cell monolayers are then lysed in laemmli's buffer and separated by SDS-PAGE on duplicate gels. One gel is processed for Western blot analysis to detect transgene (e.g., UL49.5 and/or GM-CSF) expression and the other is fixed, dried and exposed to X-ray film to determine the relative rates of viral protein synthesis at 15 hours post-infection. Pools of OV-2711 variants that replicate to high titers, maintain robust rates of viral protein synthesis and express UL49.5 or GM-CSF or both are plaque purified and high titer stocks prepared.

Two (2) 10 cm dishes of confluent Vero cell monolayers are then infected at high MOI for each of three isolates per virus listed in Table 1 and for which the gene expression cassettes are shown in FIGS. 2 and 3. Viral DNA is then isolated and analyzed by Southern blot to verify proper integration of the targeting vectors into the γ₁34.5 locus and maintenance of the Us12 gene. Variant HSV that grow to similar titers and efficiently express either mGM-CSF or UL49.5 or both transgenes (where each transgene is expressed at levels similar to the variant HSV with one copy of the corresponding transgene) are generated. The variant HSV generated in this Example encode Us12, however, they are deficient in CD8+ T-cell evasion in mice unless they express UL49.5 because Us12 does not inhibit rodent TAP.

Example 3

Generation and Isolation of Recombinant Viruses Encoding UL49.5 and GM-CSF

This Example describes the generation and isolation of variants of the wild-type HSV Strain Patton based on the OV-2711 constructs described in Example 2, above, encoding diploid CMV or EF1α promoter-controlled murine GM-CSF (mGM-CSF) gene and bovine herpes virus (BHV) UL49.5 gene alone and together.

Figure 4:
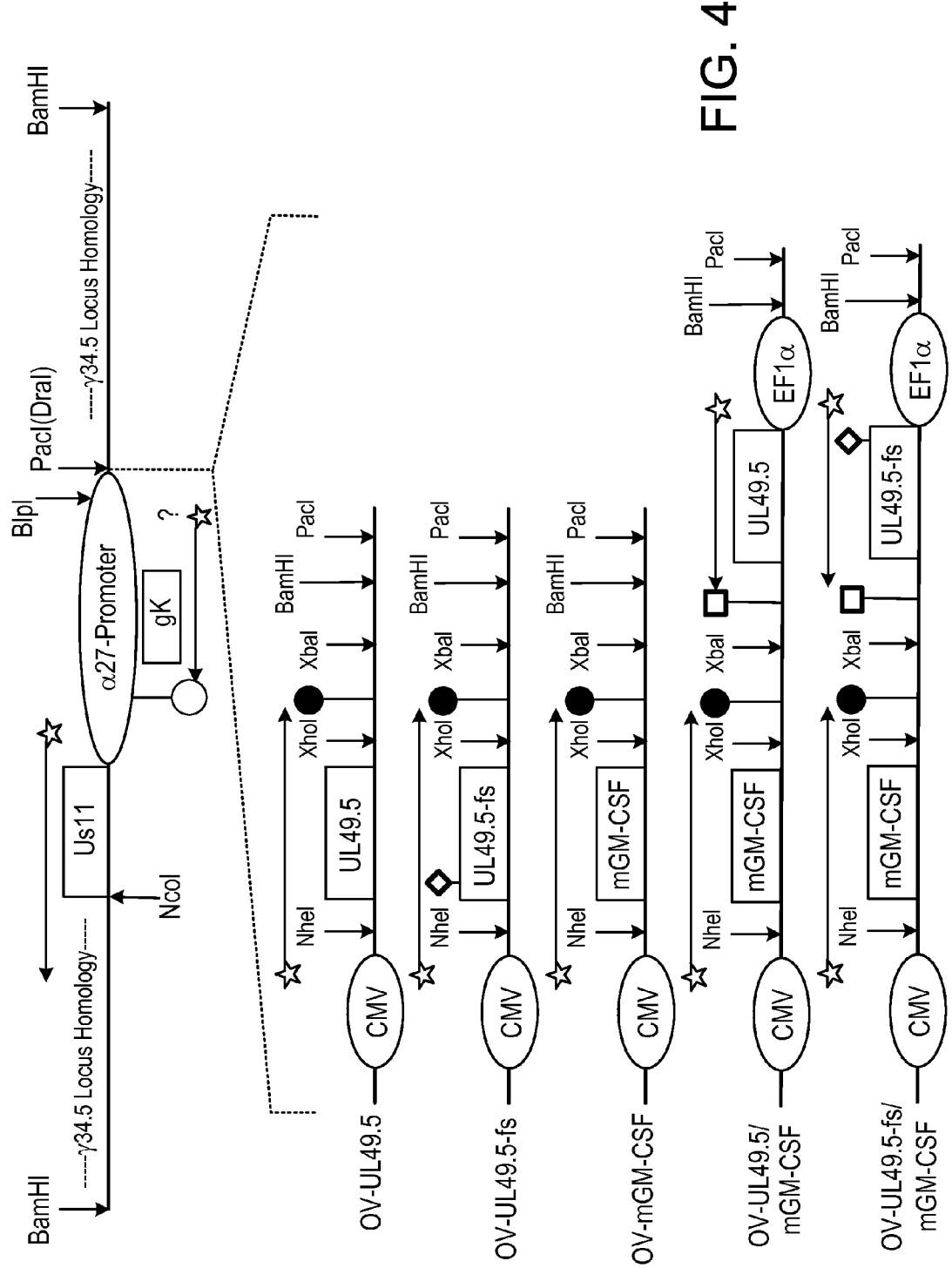
FIG. 4 illustrates the genetic constructs used to generate five specific OV-2711 variant oncolytic viruses (OV) (OV-UL49.5, OV-UL49.5-fs, OV-mGM-CSF, OV-UL49.5/GM-CSF, and OV-UL49.5-fs/mGM-CSF). In these Figures, the γ34.5 locus-targeting vector, shown at the top of FIG. 2, FIG. 3A, and FIG. 4, is derived from the viral BamSP fragment. In each targeting vector, γ34.5, located between the DraI (specifically nt#125989 of X14112) and SacI (specifically nt#125065 of X14112) sites of BamSP, is replaced by the α27-Us11 dominant selectable marker. In this process, the SacI site is destroyed and the DraI site is replaced by a PacI site. Below the targeting vector, CMV and EF1α promoter cassettes expressing either UL49.5 ("49.5") or GM-CSF ("GM") flanked by the indicated restriction endonuclease sites (marked by vertical arrows) are shown. CMV-based cassettes are terminated by the BGH polyadenylation signal (filled circle) and EF1α terminated by the SV40 late polyadenylation signal (open square).
Figure 5:
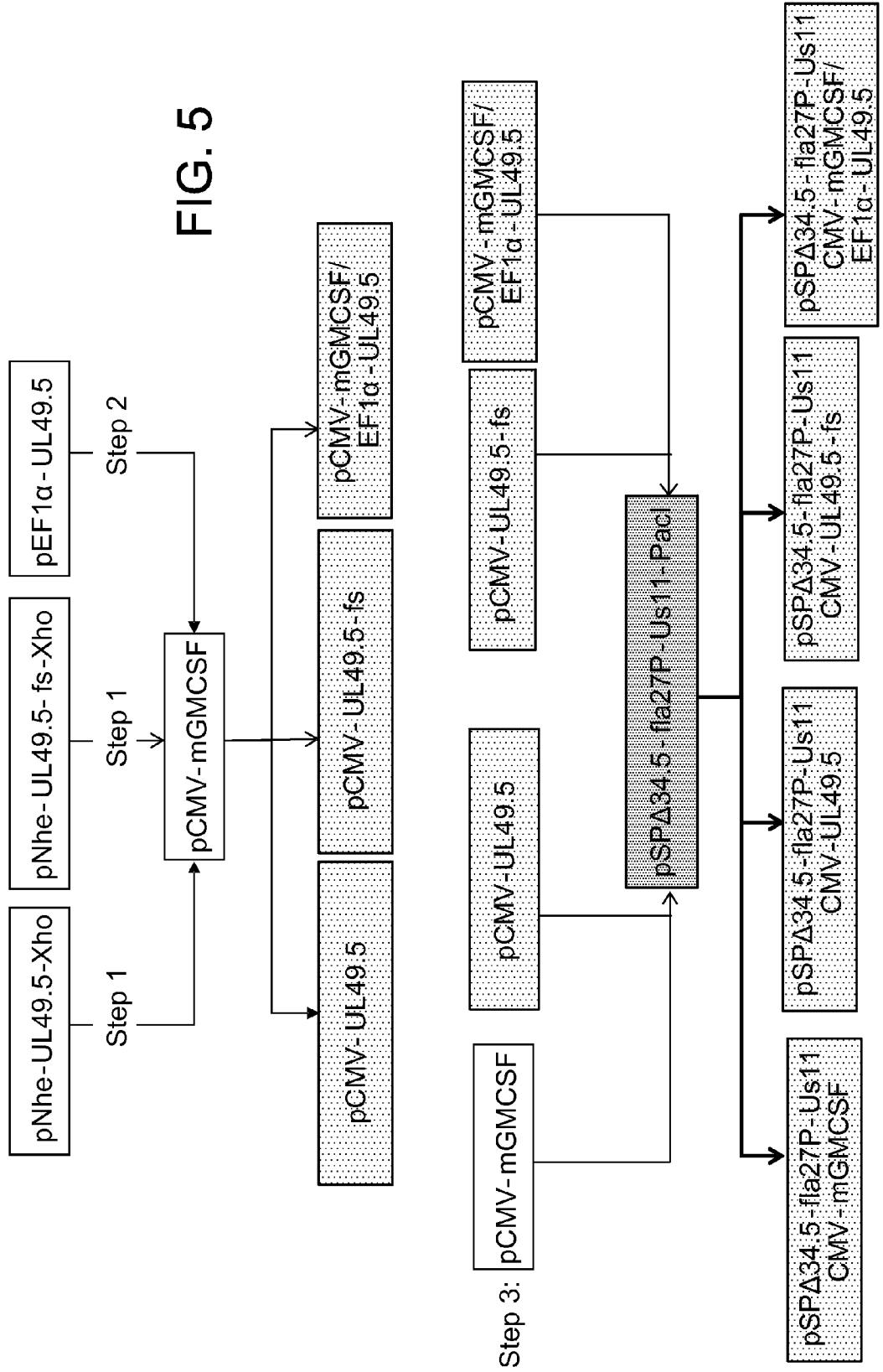
FIG. 5 is a flow diagram illustrating the strategy used to construct the targeting vectors used to make recombinant oncolytic viruses, OV-UL49.5, OV-UL49.5-fs, OV-mGM-CSF, and OV-UL49.5/mGM-CSF. Open boxes in the diagram are constructs that were synthesized de novo by GenScript Corporation (Piscataway, N.J.). The filled boxes are the constructs derived from restriction enzyme cloning.

The strategy for making the targeting vector constructs illustrated in FIG. 4 was based on linking ectopic transcription units to the immediate early expressed Us11 (IE-Us11) cassette in a vector that targets homologous recombination to the viral γ34.5 locus, as described in Example 2, above. The strategy is illustrated in FIG. 5.

The target vector construction strategy proceeded in three steps, as follows:

Step 1: pCMV-mGM-CSF was digested with NheI and XhoI to release the GM-CSF gene and the vector backbone was gel purified away from the GM-CSF containing fragment. The NheI-XhoI fragments from pNhe-UL49.5-Xho and pNhe-UL49.5-fs-Xho were isolated by digestion with NheI and XhoI followed by gel purification. These fragments were then ligated into NheI-XhoI digested pCMV-mGM-CSF to create pCMV-UL49.5 and pCMV-UL49.5-fs, respectively.

Step 2: pCMV-mGM-CSF was digested with BamHI and XbaI and the fragment containing the mGM-CSF gene under CMV promoter and BGH polyA control as well as the entire vector backbone necessary for replication, segregation and maintenance in *Escherichia coli* was gel purified. pEF1α-UL49.5 was then digested with BamHI and XbaI and the fragment containing the UL49.5 gene under EF1α and SV40 late polyA control was gel purified and ligated into XbaI-BamHI cut pCMV-GM-CSF to create pCMV-mGM-CSF/EF1α-UL49.5.

Step 3: pCMV-mGM-CSF, pCMV-UL49.5, pCMV-UL49.5-fs, and pCMV-mGM-CSF/EF1α-UL49.5 were digested with BlpI and PacI and the fragments containing the mGM-CSF and/or UL49.5 expression cassettes were gel purified and ligated into BlpI and PacI cut and purified vector pSP-434.5-fla27P-Us11-PacI to create the targeting vectors: pSP-Δ34.5-fla27P-Us11-CMV-mGM-CSF (having the nucleic acid sequence set forth in SEQ ID NO: 16), pSP-Δ34.5-fla27P-Us11-CMV-UL49.5 (having the nucleic acid sequence set forth in SEQ ID NO: 17), pSP-Δ34.5-fla27P-Us11-CMV-UL49.5-fs (having the nucleic acid sequence set forth in SEQ ID NO: 18), pSP-Δ34.5-fla27P-Us11-CMV-mGM-CSF/EF1α-UL49.5 (having the nucleic acid sequence set forth in SEQ ID NO: 19), and pSP-434.5-fla27P-Us11-CMV-mGM-CSF/EF1α-UL49.5-fs (having the nucleic acid sequence set forth in SEQ ID NO: 20). Upon successful homologous recombination, the variant HSV comprise the polynucleotide cassettes without the flanking homologous recombination regions. Thus the variant HSV comprise polynucleotide cassettes that have the following nucleic acid sequences: mGM-CSF polynucleotide cassette (SEQ ID NO: 21), UL49.5 polynucleotide cassette (SEQ ID NO: 22), UL49.5-fs polynucleotide cassette (SEQ ID NO: 23), UL49.5/mGM-CSF polynucleotide cassette (SEQ ID NO: 24), and UL49.5-fs/mGM-CSF polynucleotide cassette (SEQ ID NO: 25)

As shown in FIG. 5, the plasmid pCMV-mGM-CSF encodes the mGM-CSF gene under CMV promoter and BGH polyA control. The mGM-CSF ORF is flanked by a unique NheI restriction endonuclease site 5' of the mGM-CSF start codon and a unique XhoI site 3' of the mGM-CSF stop codon and 5' of the BGH polyA site. 3' of the BGH polyA site are unique XbaI, BamHI and PacI restriction endonuclease sites. 5' of the CMV promoter is the upstream portion of the α27 promoter region from the BlpI site to the upstream a27 promoter terminus Plasmids pNhe-UL49.5-Xho and pNhe-UL49.5-fs-Xho encode the UL49.5 and UL49.5-fs ORFs flanked by NheI and XhoI sites in order to facilitate replacement of the mGM-CSF ORF in pCMV-mGM-CSF with the UL49.5 and UL49.5-fs ORFs. pEF1α-UL49.5 encodes the UL49.5 ORF under transcriptional control of the EF1α promoter and SV40 late polyA signal. Upstream of the EF1α promoter are unique BamHI and PacI restriction endonuclease sites. Downstream of the late SV40 polyA signal is a unique XbaI restriction endonuclease site. The plasmid pSPΔ34.5-fla27P-Us11-PacI is the targeting vector illustrated in FIGS. 2, 3, and 4 and described in Example 2, above.

Using the above strategy, the following variant HSV were made and isolated, unless otherwise indicated:

1. OV-UL49.5: This variant HSV contains the same construct as the OV-mGM-CSF construct, below, except the mGM-CSF open reading frame is replaced with the BHV UL49.5 gene.
2. OV-UL49.5-fs: This variant HSV contains UL49.5 with a single nucleotide addition between the second and third UL49.5 codons to create a frameshift (fs) mutation.
3. OV-mGM-CSF: This variant HSV contains the mGM-CSF gene under control of the CMV promoter. Transcription was terminated at the BGHpA, as in OncoV-EX$^{GM-CSF}$.
4. OV-UL49.5/mGM-CSF: This variant HSV contains mGM-CSF under CMV promoter and BGHpA control, as well as UL49.5 under control of the EF1α promoter and SV40 late polyadenylation signal.
5. OV-UL49.5-fs/mGM-CSF: This variant HSV contains the same construct as the OV-UL49.5/mGM-CSF construct except that the UL49.5 fs mutation described above is incorporated. This variant HSV is a good isogenic control for the contribution evasion of CD8+ T-cells by UL49.5 makes in a viral background encoding mGM-CSF. This variant HSV is expected to be isolated easily, since OV-UL49.5/mGM-CSF was obtained.

Although the variant HSV prepared in this example were prepared from the wild-type HSV Strain Patton, which is known in the art [see, e.g., International patent application publication no. WO 2002/06513; U.S. Pat. No. 4,818,694; and Mohr, I. et al. *J. Virol.* 2001 June; 75(11): 5189-5196, and U.S. Patent Application Publication No. 20060039894], those of ordinary skill in the art will appreciate that the materials and techniques described herein may be used to prepare homologous variants of other HSV strains, including, but not limited to, a wild-type HSV Strain 17 having the nucleic acid sequence set forth in SEQ ID NO:1. Predicted nucleic acid sequence of complete variants of an HSV Strain 17, that are homologous to the variant Patton HSV OV-UL49.5, OV-UL49.5-fs, OV-mGM-CSF, OV-UL49.5/mGM-CSF, and OV-UL49.5-fs/mGM-CSF, described above, are therefore set forth in SEQ ID NOS:26-30, respectively, as non-limiting, exemplary sequences of variant HSV according to this invention.

The targeting vectors were co-transfected into Vero cells with purified Δ34.5 viral DNA, and then recombinant viruses expressing IE-Us11 were selected by growth on U251 cells, which are non-permissive for the growth of Δ34.5 viruses. Thus, IE-Us11 functioned as a dominant selectable marker in this system to select variant HSV successfully encoding the polynucleotide cassettes.

Figure 6:
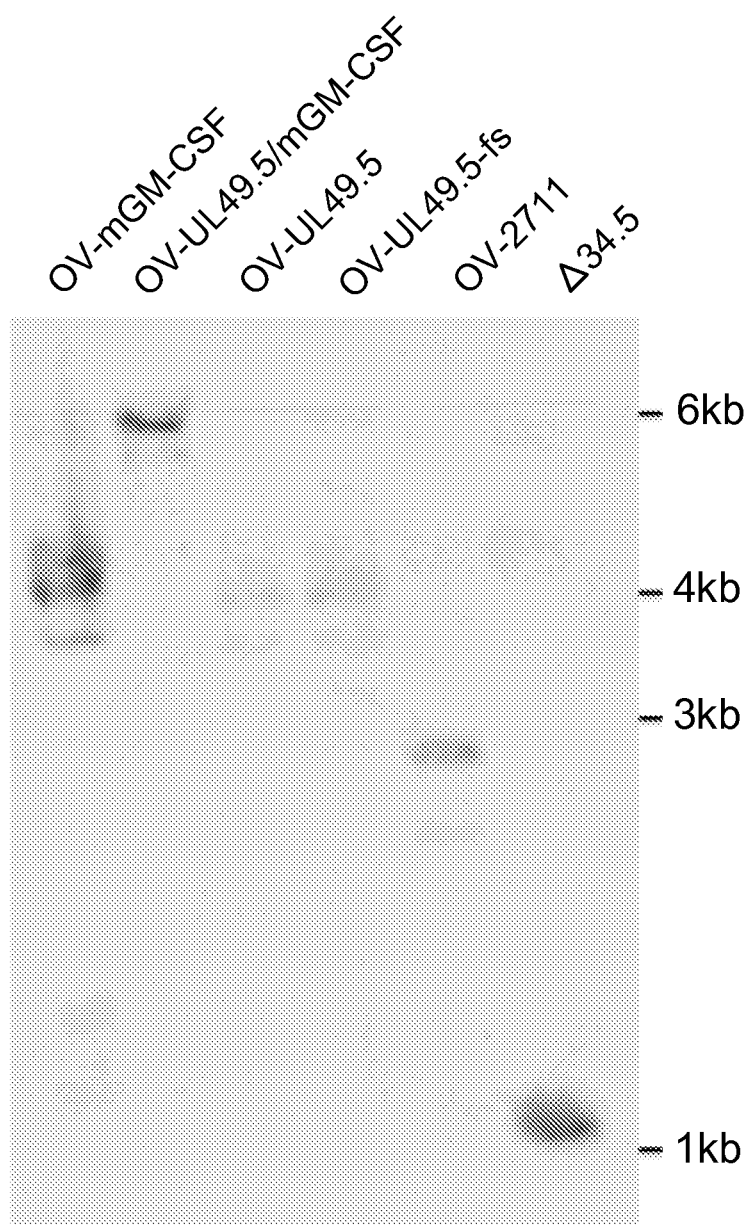
FIG. 6 contains a Southern blot result showing the presence of the indicated constructs in viral DNA from high titer viral stocks of recombinant HSV1 variants. Lanes 1 through 6, from left to right, show the presence of the constructs for the following recombinant viruses (molecular size of fragment indicated in parentheses in base pairs (bp)), respectively: 1. OV-mGM-CSF (4130 bp); 2. OV-UL49.5/mGM-CSF (6020 bp); 3. OV-UL49.5 (3995 bp); 4. OV-UL49.5-fs (3996 bp); 5. OV-2711 (2727 bp); and 6. Δ34.5 (1085 bp).

To demonstrate the successful generation and isolation of variant HSV encoding the mGM-CSF, UL49.5, UL49.5-fs, or UL49.5/mGM-CSF polynucleotide cassettes, viral DNA from high titer viral stocks derived from isolated plaques was prepared and digested with two restriction enzymes that cut outside the Δ34.5 loci and release fragments containing IEUs11 and the ectopic transgenic sequences for analysis by Southern blot. Digested DNA was separated on a 0.8% agarose gel, transferred to a nylon membrane and probed with a labeled fragment that hybridizes to the Δ34.5 locus. As shown in FIG. 6, bands in each lane agree with the predicted fragment sizes for each variant HSV generated, as well as the control viruses Δ34.5 and OV-2711.

Example 4

Infectivity of Virus Encoding the UL49.5/GM-CSF Construct

This Example demonstrates that recombinant HSV-1 engineered to encode the UL49.5/mGM-CSF construct described in Example 3, above, and as shown in FIG. 4, express the UL49.5 polypeptide, since the UL49.5 polypeptide was detected in Vero cells infected with OV-UL49.5/mGM-CSF.

Figure 7A:
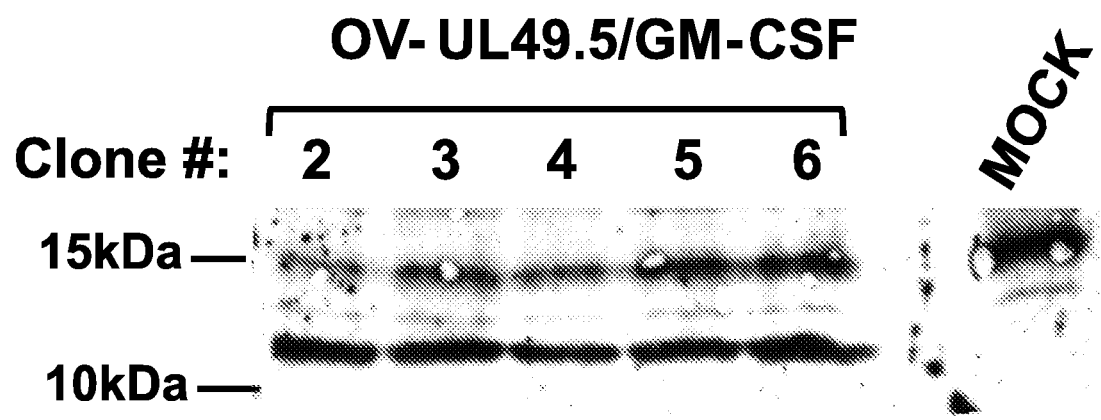
FIG. 7A contains a Western blot result showing the expression of the UL49.5 polypeptide detected in Vero cells mock infected or infected with five separate plaque purified isolates of OV-UL49.5/GM-CSF at a multiplicity of infection (MOI) equal to 1.

Vero cells were mock infected or infected with five separate plaque purified isolates of OV-UL49.5/mGM-CSF at a multiplicity of infection (MOI) equal to 1. At 24 hours post-infection, the media was aspirated and the cells were lysed in Laemmli's buffer. The lysate was then boiled to denature polypeptides, and the boiled samples were then separated by SDS-PAGE and Western blotted using an antibody raised against the UL49.5 polypeptide (anti-H11 polyclonal rabbit antibody (described in Lipinska A D, et al. J Virol 2006; 80:5822-32). As shown in FIG. 7A, protein of the expected molecular weight, approximately 12 kDa, was observed in virally-infected cells but not in the mock-infected cells. A non-specific ~15 kDa background signal demonstrated that a similar amount of mock infected sample was present compared to the virally infected samples. This ruled out the possibility that the 12 kDa band was absent from the mock-infected lane because of lower-than-expected mock sample concentration or gel loading.

Figure 7B:
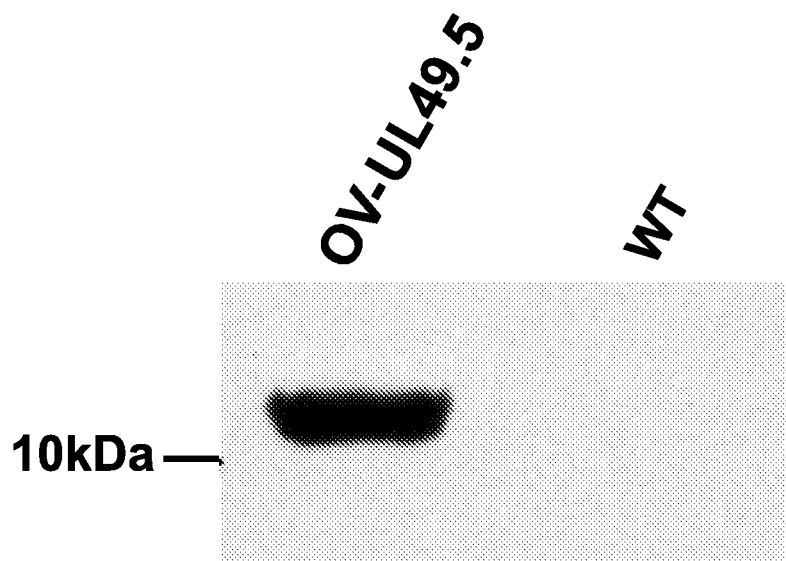
FIG. 7B contains a Western blot result showing the expression of UL49.5 polypeptide in Vero cells infected with either wild-type (WT) Patton strain HSV-1 or OV-UL49.5 at a multiplicity of infection (MOI) equal to 5.

Next, Vero cells were infected with either wild-type (WT) Patton strain HSV-1 or OV-UL49.5 at MOI=5, and, at 24 hours post-infection (PI), protein lysates were prepared and analyzed for UL49.5 polypeptide expression by Western blot, as described above. UL49.5 polypeptide clearly accumulated to easily detectable levels in cells infected with OV-UL49.5, but was not detected in cells infected with WT HSV-1, indicating that recombinant HSV-1 that encode and express the UL49.5 polypeptide (OV-UL49.5) was successfully generated (FIG. 7B).

Example 5

Detection of mGM-CSF mRNA in Mouse Balb/c Mammary 4T1 Cancer Cells Infected with BV-mGM-CSF or BV-UL49.5/GM-CSF This example demonstrates that recombinant HSV-1 engineered to encode the mGM-CSF or UL49.5/GM-CSF construct described in Example 3, above, express mGM-CSF mRNA.

Figure 8A:
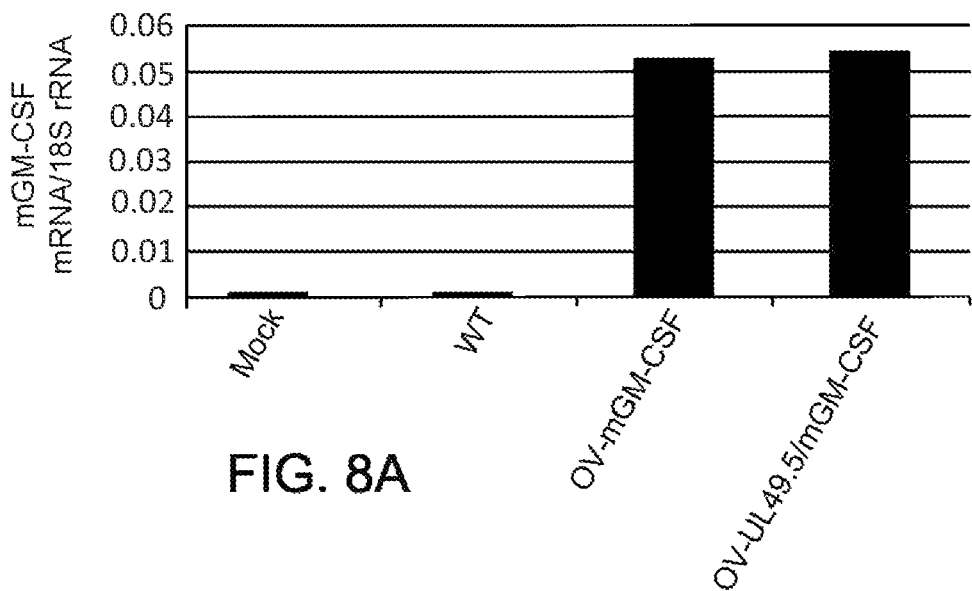
FIGS. 8A and 8B are bar graphs quantifying the expression of mGM-CSF mRNA (FIG. 7A) and VP16 (FIG. 7B) as detected by qRT-PCR and normalized to 18S rRNA signal in mouse Balb/c mammary 4T1 cancer cells mock infected or infected with wild-type (WT) Patton strain HSV-1, or with OV-mGM-CSF or OV-UL49.5/GM-CSF.

4T1 cells were either mock infected or infected with wild-type (WT), or the OV-mGM-CSF or OV-UL49.5/mGM-CSF viruses at MOI=5. At 24 hours post-infection, cells were lysed by addition of Trizol reagent (Life Technologies) and RNA was purified using RNeasy silica columns (Qiagen) according to the manufacturer's directions. Purified RNA was then treated with DNase I (new England Biolabs) for 30 mins at 37° C., EDTA added to a final concentration of 5 mM and heated for 15 mins at 75° C. to inactivate DNase I. qRT-PCR was then performed using SYBR Green detection with oligonucleotide primers that detect mouse 18S rRNA, mGM-CSF mRNA or viral VP16 mRNA. 18s rRNA was detected using a proprietary pair of primers purchased from SA Biosciences (Valencia, Calif.). mGM-CSF mRNA was detected using primers mGM-CSF-FW (5'-CTGTCACCCGGCCTTGGAAGC-3') (SEQ ID NO: 31) and mGM-CSF-RV (5'-ACAGGCATGTCATCCA-GGAGGT-3') (SEQ ID NO: 32). VP16 mRNA was detected using primers VP16-FW (5'-TCGGCGTGGAAGAAAC-GAGAGA-3') (SEQ ID NO: 33) and VP16-RV (5'-CGAACGCACCCAAATCGACA-3') (SEQ ID NO: 34).

mGM-CSF mRNA expression (normalized to 18S rRNA signal) was clearly detected in cells infected with the recombinant OV-2711 HSV variants encoding GM-CSF under CMV protocol control (OV-mGM-CSF and OV-UL49.5/mGM-CSF) (FIG. 8A). Furthermore, mGM-CSF mRNA expression was similar in cells infected with the single transgene insertion variant, OV-mGM-CSF compared to the double transgene insertion variant, OV-UL49.5/GM-CSF.

Figure 8B:
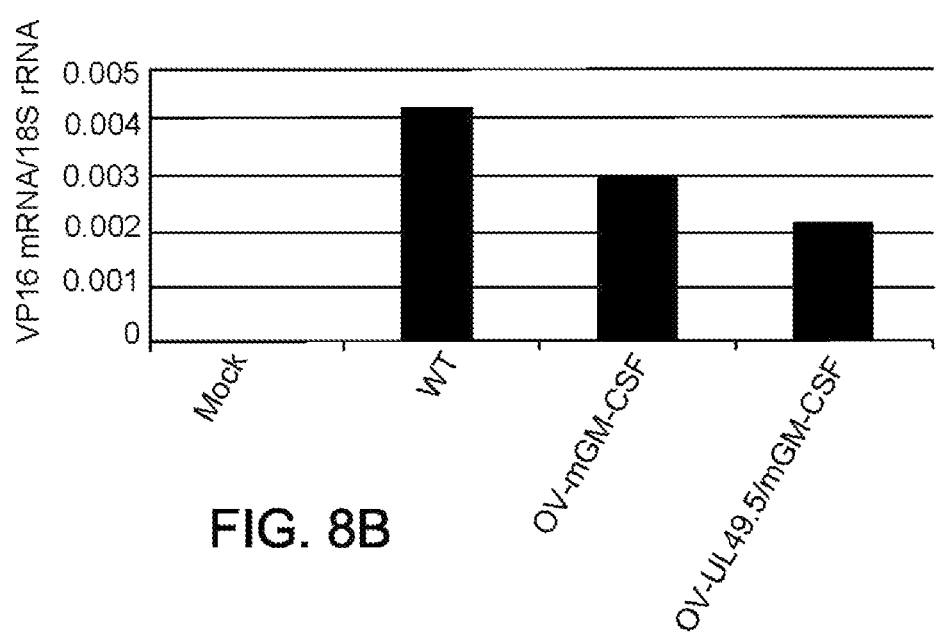
Figure 9:
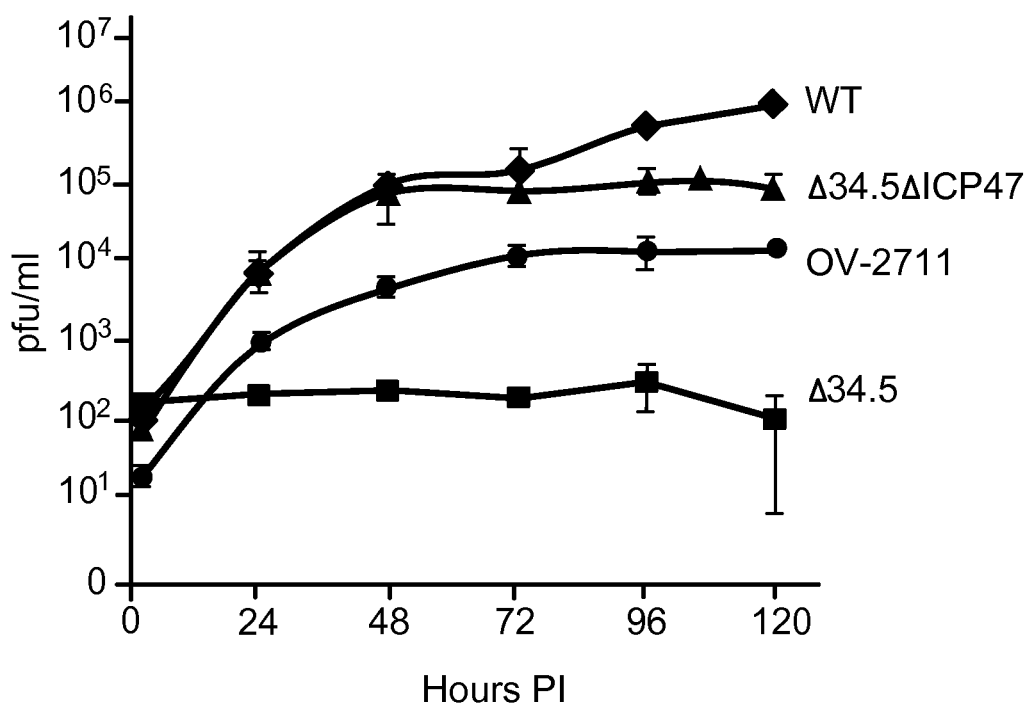
FIG. 9 is a line graph quantifying the replication (expressed as plaque forming units (pfu)/ml) of the indicated viruses (wild-type (WT), Δ34.5ΔICP47, OV-2711 and Δ34.5) in infected MBT-2 cell monolayers over time (hours post-infection (PI)).

Next, the expression of VP16 mRNA (normalized to 18S rRNA signal) was detected. VP16 is an essential HSV-1 gene, so mRNA expression is detected in all infected cells analyzed in this experiment. There was at most a two-fold difference in VP16 mRNA expression among the virally infected cells (FIG. 8B). Absence of mGM-CSF mRNA detection compared to detection of VP16 message in WT-infected cells demonstrated that the mGM-CSF signal detected (see FIG. 8A) was specific to cells infected with OV-2711 variants that encode an ectopic mGM-CSF expression cassette.

Example 6

Evaluation of Variant HSV in an MBT-2 Bladder Cancer Model

This Example demonstrates that the OV-2711 virus described in Example 1 can replicate in and spread through MBT-2 cell monolayers, which allows full evaluation of the contribution viral evasion of CD8+ T-cells makes to viral spread and anti-tumor efficacy. The experiments described in this Example can also be used to evaluate the recombinant HSV viruses encoding the constructs described in Examples 2 and 3, above.

OV-2711, as well as a Δ34.5 and Δ34.5ΔICP47 viruses were evaluated in an in vitro model of bladder cancer using MBT-2 cells. Δ34.5ΔICP47 mimics the genetic arrangement of OncoVEX$^{GM-CSF}$ that produces immediate early expressed Us11 to overcome the protein synthesis block encountered by Δ34.5 mutants.

Viruses were added to the media of replicate plates with adherent MBT-2 cell monolayers at a multiplicity of infection equal to 0.01. Duplicate sets of plates to which the indicated viruses were added were frozen at 2, 24 hours, 48, 72, 96 and 120 hours after viral addition. The plates were then thawed, the media pipetted up and down on the plate surface to detach and homogenize all cells, transferred to a 15 ml conical tube, sonicated for 15 seconds in a sonicating water bath and frozen. The tubes were then thawed and the level of infectious virus present in each sample determined by plaque assay using Vero cell monolayers, which are permissive for the replication and growth of Δ34.5 variants.

While Δ34.5 did not replicate and spread through MBT-2 monolayers, presumably due to the cellular block to protein synthesis observed in many cancer cell lines infected with Δ34.5 variants, both OV-2711 and Δ34.5ΔICP47 grew nearly as well as wild-type (WT) (FIG. 8). Although it appeared that OV-2711 accumulated to lower titers than Δ34.5ΔICP47, the OV-2711 input dose was proportionally lower in this experiment, and is expected to accumulate to similar titers as Δ34.5ΔICP47 when used at the same input dose. It was clear from this experiment that OV-2711 can replicate in and spread through MBT-2 cell monolayers. Therefore, the syngeneic MBT-2 tumor model can accurately assess the role viral evasion of anti-HSV CD8+ T-cells plays in HSV1 oncolytic virus therapeutic efficacy, and can be used to characterize the properties of the recombinant viruses encoding the constructs described in Examples 2 and 3, above.

The oncolytic viruses can also be tested as described in this Example using a suitable melanoma, ovarian, glioma and/or other cancer cell lines, in order to characterize the activity of the recombinant oncolytic viruses against cancer cells.

Example 7

Evaluation of Variant HSV in a Syngeneic, Immune-Competent Murine Model of Bladder Cancer The following experiments may be used to examine the performance of oncolytic viruses described herein (e.g., in Examples 2 and 3, above), including variant HSV based on OV-2711 (e.g., those shown in FIGS. 3 and 4), and to compare the performance of such viruses with other viruses known in the art, such as OncoVEX$^{GMCSF}$ and viruses similar thereto. The experiments demonstrate that functions known to preclude recognition of infected cells by CD8+ T-cells will result in enhanced tumor reduction without compromising viral-mediated tumor antigen vaccination.

In addition to direct oncolysis, an immune-mediated component contributes to HSV-1 oncolytic virus efficacy in immune-competent mice. Using immune-competent mice with syngeneic, bilateral subcutaneous (s.c.) tumors, previous studies established that treatment of one tumor with oncolytic virus induced regression of the treated and untreated contralateral tumor (see Toda M, et al. "Herpes simplex virus as an in situ cancer vaccine for the induction of specific anti-tumor immunity." Hum Gene Ther 1999; 10:385-93). While treated and untreated tumors both regressed, oncolytic virus was only detected in the treated tumor. Furthermore, regression of the uninjected, contralateral tumor resulted from an anti-tumor CD8+ T-cell response. A pre-existing host immune response capable of neutralizing HSV-1, however, would likely limit oncolytic virus spread through the injected tumor and diminish the efficiency at which antitumor immunity develops.

These experiments compare the oncolytic and immune evasion properties of the variant HSV that are generated as described in Examples 2 and 3, above, in a syngeneic, immune-competent murine model of bladder cancer, in which the mice are seropositive for HSV-1. In particular, the experiments demonstrate that HSV variants having intact endogenous Us11 and Us12 genes, and lacking ICP34.5 encoding genes, wherein the ICP34.5 encoding genes are replaced by IE-Us11 and UL49.5 (TAP inhibitor) or by IE-Us11, UL49.5 and GM-CSF ("OV-UL49.5" or "OV-UL49.5-GM-CSF", respectively), are superior to HSV lacking immune evasion abilities (e.g., the ability to inhibit TAP or otherwise evade cytolytic CD8+ T cell responses), such as OncoVEX$^{GMCSF}$ or OV-2711 (although OV-2711 encodes Us12 and is predicted to inhibit TAP function in human cells, it is defective in Us12 function during infection of rodent cells because the Us12 polypeptide exhibits significantly reduced affinity for and inhibitory activity against rodent TAP), because they can persist longer in the tumor and have greater capacity i) for direct oncolysis; and ii) to stimulate systemic anti-tumor immunity.

To compare the anti-tumor activity of variant HSV that evade CD8+ T-cells ("OV-UL49.5" & "OV-UL49.5-GM-CSF") in mice with those that cannot ("OV-2711" & "OV-mGM-CSF"), immune-competent mice are first immunized with a non-neuorovirulent, replication competent HSV-1, or a sub-lethal dose of WT virus, as described in Chahlavi A, et al. "Effect of prior exposure to herpes simplex virus 1 on viral vector-mediated tumor therapy in immunocompetent mice." Gene Ther (1999) 6:1751-8, to mimic HSV-1 sero-positive humans or those that convert to sero-positivity after oncolytic virus-treatment.

HSV-1$^+$ immune response development is monitored by ELISA for the appearance of virus-neutralizing antibodies [see, Chahlavi A, et al. "Effect of prior exposure to herpes simplex virus 1 on viral vector-mediated tumor therapy in immunocompetent mice." Gene Ther (1999) 6:1751-8]. Three (3) months are allowed to pass in order to ensure the development of a memory immune response, at which time a set of mice are challenged with virulent virus to prove that memory has been established physiologically and functionally, by detecting presence of anti-HSV-1 cytotoxic T lymphocytes (CTLs) [see, Kavanagh D G, Gold M C, Wagner M, Koszinowski U H, Hill A B. J Exp Med. 2001 Oct. 1; 194(7):967-78. Next, syngeneic s.c. MBT-2 mouse BC seed tumors are implanted bilaterally into each flank of HSV-1-vaccinated C3H/HeJ mice (Charles River Breeding Laboratories). The seed tumors are prepared by injecting 1×10$^8$ MBT-2 cells [see, Mickey D D, et al. (1982) J. Urol. 127(6):1233-7] s.c. into the flank of a BALB/c nu/nu outbred mouse (Charles River Breeding Laboratories). Tumors are measured every other day with Vernier calipers and their volume determined by using the formula 0.52×width× height×depth. Once the tumor size reaches 150 mm$^3$, the animal is euthanized, and the explanted tumor sectioned into 2×2×2 mm fragments. Individual tumor fragments are then surgically implanted s.c. into naïve mice. When tumors reach 50 mm$^3$, a 50 μl solution of oncolytic virus is injected directly into the tumor.

A s.c. tumor model has significant advantages for this experiment, as it allows precise, non-invasive tumor measurements over time; oncolytic virus-treated and untreated tumor growth on different flanks can be compared directly; and untreated tumors on contralateral flanks can be directly monitored for viral antigens.

A range of HSV-variant doses can be tested in groups of 5 HSV-1-vaccinated animals with 50 mm$^3$ MBT-2 tumors implanted s.c. on both flanks (Vero lysate, 10$^6$, 10$^7$, and 10$^8$ pfu-20 mice). OV-2711 is administered on days 1, 3 and 5, and tumor size measured as described above. Although this regimen with a 5×10$^6$ pfu dose of 2711 eliminates the growth of tumors in nude mice, lower efficacy for OV-2711 is expected in immune-competent HSV-1-vaccinated mice due to premature clearance of 2711 by CD8+ T-cells and other components of the immune system. Despite the ability to inhibit TAP-mediated viral antigen presentation, it is expected that inhibition is not absolute and a low level of viral antigens are displayed on MHC-I. TAP inhibition simply slows the rate at which the virus is cleared by CD8+ T-cells compared to a corresponding virus that is deficient in functions capable of efficiently inhibiting TAP function. Therefore, higher doses are tested to determine the lowest viral dose that yields maximal tumor regression (lowest effective dose—LED). Tumor volume may be monitored as described above for up to 60 days.

Following establishment of the dynamic range of OV-2711 efficacy in immune-competent HSV-1 vaccinated animals, the panel of variant HSV described in Examples 2 and 3, and having the genetic modifications shown in FIGS. 2, 3 and/or 4 are tested. The dose of infectious virus is expected to be 10-fold below the OV-2711 LED. This should provide a suitable dynamic range to evaluate the contribution UL49.5 and mGM-CSF expression make to increased oncolytic virus efficacy. Tumor volume may be monitored over time as described above. Since oncolytic viruses do not spread to the uninjected contralateral tumor, the size of the contralateral tumor is a good measure of the efficiency of oncolytic virus-mediated tumor vaccination. Animals may be sacrificed when they exhibit signs of excessive tumor burden or appear moribund, the wet weight of the tumors recorded, and the tumor tissue flash frozen and stored for future analysis to detect viral replication and CD8+ T-cell infiltration by immunohistochemistry (IHC) with anti-HSV-1 and anti-CD8 antibodies, respectively (as available, e.g., from Abcam® (Cambridge, Mass.) and Santa Cruz Biotechnology (Santa Cruz, Calif.)).

It is expected that: i) injected and uninjected tumors will regress, but virus will only be detected in the injected tumor; and ii) regression of the uninjected, contralateral tumor results from an anti-tumor T-cell response. Results from these experiments will define how Us12-like immune-evasion functions contribute to oncolytic virus efficacy and the development of anti-tumor immunity. If CD8+ T-cell evasion contributes to oncolytic virus efficacy, a greater reduction in the size of OV-UL49.5-injected and corresponding contralateral tumors compared to tumors in mice treated with OV-2711 or OV-mGM-CSF is expected. It is also expected that tumors injected with OV-UL49.5-GM-CSF, will have enhanced APC recruitment by mGM-CSF coupled with improved viral spread conferred by UL49.5, and that the OV-UL49.5-GM-CSF variant will prove to be a superior oncolytic virus for the treatment of bladder cancer.

The oncolytic viruses describe above can also be tested as described in this Example using suitable in vivo animal models of melanoma, ovarian, glioma and/or other cancers, in order to characterize the activity of the recombinant oncolytic viruses against cancer cells. Such animal models are known in the art and described in detail herein, above.

A number of embodiments of the invention have been described. Nevertheless, it will be understood that various modifications may be made without departing from the spirit and scope of the invention. Accordingly, other embodiments are within the scope of the following claims.

SEQUENCE LISTING (34 sequences)

SEQ ID NO: 1 - DNA, 152261 bp, simplexvirus/Herpes simplex virus 1
  ref <308>: DATABASE ACCESSION NUMBER: GenBank Accession No. X14112.1
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggcagcccgggccccccgcggccgagactagcgagttagacaggcaagcactactcgcctctgcacgcacatgcttgcctgtcaaactctaccaccccggcacgctctctgtctccatggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaacgttacacccgaggcggcctgggtcttccgcggagctcccgggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctcccgggagctccgcggaagacccaggccgcctcgggtgtaacgttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccatggagacagagagcgtgccggggtggtagagtttgacaggcaagcatgtgcgtgcagaggcgagtagtgcttgcctgtctaactcgctagtctcggccgcggggggcccgggctgcccgccgccaccgctttaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 2 - DNA, 486 bp, simplexvirus/Herpes simplex virus 1
ctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcat

SEQ ID NO: 3 - DNA, 267 bp, simplexvirus/Herpes simplex virus 1
tcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacat

SEQ ID NO: 4 - DNA, 747 bp, simplexvirus/Herpes simplex virus 1
atggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaa

SEQ ID NO: 5 - DNA, 747 bp, simplexvirus/Herpes simplex virus 1
ttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccat

SEQ ID NO: 6 - DNA, 865 bp, simplexvirus/Herpes simplex virus 1
gagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcg

SEQ ID NO: 7 - DNA, 4896 bp, simplexvirus/Herpes simplex virus 1
ggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatcc

SEQ ID NO: 8 - DNA, 4896 bp, simplexvirus/Herpes simplex virus 1; identical to SEQ ID NO: 7

SEQ ID NO: 9 - DNA, 1356 bp, simplexvirus/Herpes simplex virus 1
gtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcggg

SEQ ID NO: 10 - DNA, 1658 bp, simplexvirus/Herpes simplex virus 1
cctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccga

SEQ ID NO: 11 - DNA, 1400 bp, simplexvirus/Herpes simplex virus 1
cccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgac

SEQ ID NO: 12 - DNA, 1604 bp, simplexvirus/Herpes simplex virus 1
ccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcc

SEQ ID NO: 13 - DNA, 1604 bp, simplexvirus/Herpes simplex virus 1
ggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcgg

SEQ ID NO: 14 - DNA, 3575 bp, simplexvirus/Herpes simplex virus 1
aaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatcc

SEQ ID NO: 15 - DNA, 1017 bp, simplexvirus/Herpes simplex virus 1
atgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatga

SEQ ID NO: 16 - DNA, 13145 bp, Artificial Sequence
  targeting plasmid
ttctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 17 - DNA, 13010 bp, Artificial Sequence
  targeting plasmid
ttctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccgcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 18 - DNA, 13011 bp, Artificial Sequence
  targeting plasmid
ttctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccggcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 19 - DNA, 15035 bp, Artificial Sequence
  targeting plasmid
ttctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgcggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 20 - DNA, 15036 bp, Artificial Sequence
  targeting plasmid
ttctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgccggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaa

SEQ ID NO: 21 - DNA, 3695 bp, Artificial Sequence
  polynucleotide cassette
ttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctc

SEQ ID NO: 22 - DNA, 3560 bp, Artificial Sequence
  polynucleotide cassette
ttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccgcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctc

SEQ ID NO: 23 - DNA, 3561 bp, Artificial Sequence
  polynucleotide cassette
ttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccggcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctc

SEQ ID NO: 24 - DNA, 5585 bp, Artificial Sequence
  polynucleotide cassette
ttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgcggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctc

SEQ ID NO: 25 - DNA, 5586 bp, Artificial Sequence
  polynucleotide cassette
ttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgccggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctc

SEQ ID NO: 26 - DNA, 157529 bp, Artificial Sequence
  recombinant virus
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccgcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctccaccgcggtggcggccgctctagagtggggagaaggggtctgggctcgccaggggggcatacttgcccgggctatacagacccgcgagccgtacgtggttcgcggggggtgcgtggggtccggggctcccggggagaccggggctccctgggagaccggggttgtcgtggatccctggggtcacgcggtaccctggggtctctgggatctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttacaagcttcggggagaggcaccgaagcgtgaccgtggttggaacacggctgcacaccaccaccggccgggtggtggatgtccttatacccgtggtgccggggccggctctcccaaacccctcctcgttccgccccccgggcggggcccccgccccacctccggcacagacaaggaccaatcagacaccataagtacgtggcatgtatttaattagcatatcacataccccgttccgcttccgcggggacccgggcgggggtggatacgctggctgggttggtcttggtaacgggacggccaattgggacccatgggcggggtcgttgggatccaggctacacgtggcctcgggggaccgattttcatttgcatatgacgcgtcgggtgggtgggccccaagacaggacagtttccaatttgcatatgccgttacggtttccgccggcctggatgtgacgtcatacatcaaacaggcgcctctggatctcctgctcgtagtgaagcgccacgagcaccaccccggccaccacggcgatataacacaatcgcactgcgatgcccgagaggatgatggaacagcagcgcccgcagacgcccgacagccccttggatcgccccggggcggcggccttgtctgcgttcttgggggccgggccccgccgcagaatacaatacagctctgtcaggccgatggtggagacaaaacaccaggtggtgatggtcagaaacagggggtatgtgatcgcacatgccccccgggatatgaaagcggtgccgacgatgagacccacggccacaaagcgtagcatcaactcgcagcctacgatgaccccgatggcggggcggtggtacaagaaggtgaccgggtccgtctcaaacaactgaaccaggttttgccgctggaccgacagctcgcagagcaggcgggtaattttcgtgtaggggtactgcaggaacacgctcgatacgatgcggcctgcgtagttcaagaggtaggtggccggggccaccatcttgtgggcgggactcacgacgccaaacatacatcggcgttggtggagggcgacgaacgccagatacaggaaccaccctacgaccaccagacgcacccgtgtgtaccatagggtctccagacagttaactgcctcgtggacgttcatgatccgacgattcatggcgtcaggtgggacctggaagggcacgaccctacccgcgataagattggcgtagcagatatgggcgtggttgcgccagcccccgttgggggggtgcgtcggggcccccagaaacaatagggtctggttcattttcatccacacgagggcggtgtcgttgttggtgccggtggggcgtaccgcgtaaatacatcggtgcagcggactggcaccgaagacggtgtaccacacgagcacgaggccgtacgccgttatcaagacgacggttgagaggtgctgcagggaacggacggcgagcatggcgtgccggcgtcaatggtaaacagcgtgtgcaggcggttgctgtcgcatttggcggcaaagcactgctgacacaaggacacgcacaggcggttgttggccccgacgctcagcgcgacgaatgtccgcgccgtggcgcgactcgcccggccgtgcttaaagcgcagacacgacaggctttgctgcaggcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatccgctagcgctaccggtcgccaccatgccgcggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgaggaagcccaggccagctcgagcatgcagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggtctagactgcagggatccttaattaaaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 27 - DNA, 157531 bp, Artificial Sequence
  recombinant virus
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccggcggcatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctccaccgcggtggcggccgctctagagtggggagaaggggtctgggctcgccaggggggcatacttgcccgggctatacagacccgcgagccgtacgtggttcgcggggggtgcgtggggtccggggctcccggggagaccggggctccctgggagaccggggttgtcgtggatccctggggtcacgcggtaccctggggtctctgggatctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttacaagcttcggggagaggcaccgaagcgtgaccgtggttggaacacggctgcacaccaccaccggccgggtggtggatgtccttatacccgtggtgccggggccggctctcccaaacccctcctcgttccgccccccgggcggggcccccgccccacctccggcacagacaaggaccaatcagacaccataagtacgtggcatgtatttaattagcatatcacataccccgttccgcttccgcggggacccgggcgggggtggatacgctggctgggttggtcttggtaacgggacggccaattgggacccatgggcggggtcgttgggatccaggctacacgtggcctcgggggaccgattttcatttgcatatgacgcgtcgggtgggtgggccccaagacaggacagtttccaatttgcatatgccgttacggtttccgccggcctggatgtgacgtcatacatcaaacaggcgcctctggatctcctgctcgtagtgaagcgccacgagcaccaccccggccaccacggcgatataacacaatcgcactgcgatgcccgagaggatgatggaacagcagcgcccgcagacgcccgacagccccttggatcgccccggggcggcggccttgtctgcgttcttgggggccgggccccgccgcagaatacaatacagctctgtcaggccgatggtggagacaaaacaccaggtggtgatggtcagaaacagggggtatgtgatcgcacatgccccccgggatatgaaagcggtgccgacgatgagacccacggccacaaagcgtagcatcaactcgcagcctacgatgaccccgatggcggggcggtggtacaagaaggtgaccgggtccgtctcaaacaactgaaccaggttttgccgctggaccgacagctcgcagagcaggcgggtaattttcgtgtaggggtactgcaggaacacgctcgatacgatgcggcctgcgtagttcaagaggtaggtggccggggccaccatcttgtgggcgggactcacgacgccaaacatacatcggcgttggtggagggcgacgaacgccagatacaggaaccaccctacgaccaccagacgcacccgtgtgtaccatagggtctccagacagttaactgcctcgtggacgttcatgatccgacgattcatggcgtcaggtgggacctggaagggcacgaccctacccgcgataagattggcgtagcagatatgggcgtggttgcgccagcccccgttgggggggtgcgtcggggcccccagaaacaatagggtctggttcattttcatccacacgagggcggtgtcgttgttggtgccggtggggcgtaccgcgtaaatacatcggtgcagcggactggcaccgaagacggtgtaccacacgagcacgaggccgtacgccgttatcaagacgacggttgagaggtgctgcagggaacggacggcgagcatggcgtgccggcgtcaatggtaaacagcgtgtgcaggcggttgctgtcgcatttggcggcaaagcactgctgacacaaggacacgcacaggcggttgttggccccgacgctcagcgcgacgaatgtccgcgccgtggcgcgactcgcccggccgtgcttaaagcgcagacacgacaggctttgctgcaggcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatccgctagcgctaccggtcgccaccatgccgccggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgaggaagcccaggccagctcgagcatgcagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggtctagactgcagggatccttaattaaaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 28 - DNA, 157799 bp, Artificial Sequence
  recombinant virus
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccctgcagtctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctccaccgcggtggcggccgctctagagtggggagaaggggtctgggctcgccaggggggcatacttgcccgggctatacagacccgcgagccgtacgtggttcgcggggggtgcgtggggtccggggctcccggggagaccggggctccctgggagaccggggttgtcgtggatccctggggtcacgcggtaccctggggtctctgggatctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttacaagcttcggggagaggcaccgaagcgtgaccgtggttggaacacggctgcacaccaccaccggccgggtggtggatgtccttatacccgtggtgccggggccggctctcccaaacccctcctcgttccgccccccgggcggggcccccgccccacctccggcacagacaaggaccaatcagacaccataagtacgtggcatgtatttaattagcatatcacataccccgttccgcttccgcggggacccgggcgggggtggatacgctggctgggttggtcttggtaacgggacggccaattgggacccatgggcggggtcgttgggatccaggctacacgtggcctcgggggaccgattttcatttgcatatgacgcgtcgggtgggtgggccccaagacaggacagtttccaatttgcatatgccgttacggtttccgccggcctggatgtgacgtcatacatcaaacaggcgcctctggatctcctgctcgtagtgaagcgccacgagcaccaccccggccaccacggcgatataacacaatcgcactgcgatgcccgagaggatgatggaacagcagcgcccgcagacgcccgacagccccttggatcgccccggggcggcggccttgtctgcgttcttgggggccgggccccgccgcagaatacaatacagctctgtcaggccgatggtggagacaaaacaccaggtggtgatggtcagaaacagggggtatgtgatcgcacatgccccccgggatatgaaagcggtgccgacgatgagacccacggccacaaagcgtagcatcaactcgcagcctacgatgaccccgatggcggggcggtggtacaagaaggtgaccgggtccgtctcaaacaactgaaccaggttttgccgctggaccgacagctcgcagagcaggcgggtaattttcgtgtaggggtactgcaggaacacgctcgatacgatgcggcctgcgtagttcaagaggtaggtggccggggccaccatcttgtgggcgggactcacgacgccaaacatacatcggcgttggtggagggcgacgaacgccagatacaggaaccaccctacgaccaccagacgcacccgtgtgtaccatagggtctccagacagttaactgcctcgtggacgttcatgatccgacgattcatggcgtcaggtgggacctggaagggcacgaccctacccgcgataagattggcgtagcagatatgggcgtggttgcgccagcccccgttgggggggtgcgtcggggcccccagaaacaatagggtctggttcattttcatccacacgagggcggtgtcgttgttggtgccggtggggcgtaccgcgtaaatacatcggtgcagcggactggcaccgaagacggtgtaccacacgagcacgaggccgtacgccgttatcaagacgacggttgagaggtgctgcagggaacggacggcgagcatggcgtgccggcgtcaatggtaaacagcgtgtgcaggcggttgctgtcgcatttggcggcaaagcactgctgacacaaggacacgcacaggcggttgttggccccgacgctcagcgcgacgaatgtccgcgccgtggcgcgactcgcccggccgtgcttaaagcgcagacacgacaggctttgctgcaggcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatccgctagcgctaccggtcgccaccatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgaggaagcccaggccagctcgagcatgcagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggtctagactgcagggatccttaattaaaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 29 - DNA, 161579 bp, Artificial Sequence
  recombinant virus
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgcggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctccaccgcggtggcggccgctctagagtggggagaaggggtctgggctcgccaggggggcatacttgcccgggctatacagacccgcgagccgtacgtggttcgcggggggtgcgtggggtccggggctcccggggagaccggggctccctgggagaccggggttgtcgtggatccctggggtcacgcggtaccctggggtctctgggatctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttacaagcttcggggagaggcaccgaagcgtgaccgtggttggaacacggctgcacaccaccaccggccgggtggtggatgtccttatacccgtggtgccggggccggctctcccaaacccctcctcgttccgccccccgggcggggcccccgccccacctccggcacagacaaggaccaatcagacaccataagtacgtggcatgtatttaattagcatatcacataccccgttccgcttccgcggggacccgggcgggggtggatacgctggctgggttggtcttggtaacgggacggccaattgggacccatgggcggggtcgttgggatccaggctacacgtggcctcgggggaccgattttcatttgcatatgacgcgtcgggtgggtgggccccaagacaggacagtttccaatttgcatatgccgttacggtttccgccggcctggatgtgacgtcatacatcaaacaggcgcctctggatctcctgctcgtagtgaagcgccacgagcaccaccccggccaccacggcgatataacacaatcgcactgcgatgcccgagaggatgatggaacagcagcgcccgcagacgcccgacagccccttggatcgccccggggcggcggccttgtctgcgttcttgggggccgggccccgccgcagaatacaatacagctctgtcaggccgatggtggagacaaaacaccaggtggtgatggtcagaaacagggggtatgtgatcgcacatgccccccgggatatgaaagcggtgccgacgatgagacccacggccacaaagcgtagcatcaactcgcagcctacgatgaccccgatggcggggcggtggtacaagaaggtgaccgggtccgtctcaaacaactgaaccaggttttgccgctggaccgacagctcgcagagcaggcgggtaattttcgtgtaggggtactgcaggaacacgctcgatacgatgcggcctgcgtagttcaagaggtaggtggccggggccaccatcttgtgggcgggactcacgacgccaaacatacatcggcgttggtggagggcgacgaacgccagatacaggaaccaccctacgaccaccagacgcacccgtgtgtaccatagggtctccagacagttaactgcctcgtggacgttcatgatccgacgattcatggcgtcaggtgggacctggaagggcacgaccctacccgcgataagattggcgtagcagatatgggcgtggttgcgccagcccccgttgggggggtgcgtcggggcccccagaaacaatagggtctggttcattttcatccacacgagggcggtgtcgttgttggtgccggtggggcgtaccgcgtaaatacatcggtgcagcggactggcaccgaagacggtgtaccacacgagcacgaggccgtacgccgttatcaagacgacggttgagaggtgctgcagggaacggacggcgagcatggcgtgccggcgtcaatggtaaacagcgtgtgcaggcggttgctgtcgcatttggcggcaaagcactgctgacacaaggacacgcacaggcggttgttggccccgacgctcagcgcgacgaatgtccgcgccgtggcgcgactcgcccggccgtgcttaaagcgcagacacgacaggctttgctgcaggcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatccgctagcgctaccggtcgccaccatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgaggaagcccaggccagctcgagcatgcagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggtctagataccacatttgtagaggttttacttgctttaaaaaacctcccacatctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgctcgaagcattaaccctcactaaagggaatcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccgcggcatggtggcgaccggtagatcctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcacgcatgctcttctccacctcagtgatgacgagagcgggcgggtgagggggcgggaacgcagcgatctctgggttctacgttagtgggagtttaacgacggtccctgggattccccaaggcaggggcgagtccttttgtatgaattactcggatccttaattaaaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 30 - DNA, 161581 bp, Artificial Sequence
  recombinant virus
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttttaattaaggatccgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggatctaccggtcgccaccatgccgccggtcgccgctcatcgttgcggttgtggccgccgcgctgtttgccatcgtgcgcggccgcgaccccctgctagacgcgatgcggcgcgagggggcaatggacttttggagcgcaggctgctacgcgcgcggggtgccgctctcggagccaccgcaggccctggttgttttttacgtggccctgaccgcggtaatggtcgccgtggccctgtacgcgtacgggctttgctttaggctcatgggcgccagcgggcccaataaaaaggagtcgcgggggcggggctgattccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtatctagaccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctgcatgctcgagctggcctgggcttcctcatttttggactggttttttgcattcaaaggggatatcagtcagaaaggttttaaggctgtctatgaaatccgcataggtggtaacttgtgtttcacagtccgtttccggagttggggggcagtatgtctggtagtagctggctgtcatgttcaaggcgcccttgagtttggtgaaattgccccgtagaccctgctcgaatatcttcaggcgggtctgcacacatgttagcttcttgaaggagaactcgttagagacgacttctacctcttcattcaatgtgacaggcatgtcatccaggaggttcagggcttctttgatggcctctacatgcttccaaggccgggtgacagtgatgggtgagcgggtgggtgctgagaggctgtagaccacaatgcccaggaaaagtaaattctgcagccacatggtggcgaccggtagcgctagcggatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgaagcttgtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagatcccagagaccccagggtaccgcgtgaccccagggatccacgacaaccccggtctcccagggagccccggtctccccgggagccccggaccccacgcaccccccgcgaaccacgtacggctcgcgggtctgtatagcccgggcaagtatgcccccctggcgagcccagaccccttctccccactctagagcggccgccaccgcggtggagctccgcaccaagccgctctccggagagacgatggcaggagccgcgcatatatacgcttggagccagcccgccctcacagggcgggccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccatggagccccgccccggagcgagtacccgccggcctgagggccgcccccagcgcgaggtgaggggccgggcgccatgtctggggcgccatattggggggcgccatattggggggcgccatgttgggggacccccgacccttacactggaaccggccgccatgttgggggacccccactcatacacgggagccgggcgccatgttggggcgccatgttagggggcgtggaaccccgtgacactatatatacagggaccgggggcgccatgttagggggtgcggaaccccctgaccctatatatacagggaccggggtcgccctgttgggggtcgccatgtgaccccctgactttatatatacagacccccaacacatacacatggcccctttgactcagacgcagggcccggggtcgccgtgggaccccctgactcatacacagagacacgcccccacaacaaacacacaaggaccggggtcgccgtgttgggggcgtggtccccactgactcatacgcaggccccccttactcacacgcatctaggggggtggggaggagccgcccgccatatttgggggacgccgtgggacccccgactccggtgcgtctggagggcgggagaagagggaagaagaggggtcgggatccaaaggacggacccagaccacctttggttgcagacccctttctcccccctcttccgaggccagcaggggggcaggactttgtgaggcgggggggggagagggggaactcgtgggtgctgattgacgcgggaaatccccccccattcttacccgccccccttttttccccttagcccgccccggatgtctgggtgtttccctgcgaccgagacctgccggacagcagcgactctgaggcggagaccgaagtgggggggcggggggacgccgaccaccatgacgacgactccgcctccgaggcggacagcacggacacggaactgttcgagacggggctgctggggccgcagggcgtggatgggggggcggtctcgggggggagccccccccgcgaggaagaccccggcagttgcgggggcgccccccctcgagaggacggggggagcgacgagggcgacgtgtgcgccgtgtgcacggatgagatcgcgccccacctgcgctgcgacaccttcccgtgcatgcaccgcttctgcatcccgtgcatgaaaacctggatgcaattgcgcaacacctgcccgctgtgcaacgccaagctggtgtacctgatagtgggcgtgacgcccagcgggtcgttcagcaccatcccgatcgtgaacgacccccagacccgcatggaggccgaggaggccgtcagggcgggcacggccgtggactttatctggacgggcaatcagcggttcgccccgcggtacctgaccctgggggggcacacggtgagggccctgtcgcccacccacccggagcccaccacggacgaggatgacgacgacctggacgacggtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgcggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccccctcaccaccattcctactaccaccaccaccaccaccaccgacacctcccgcgcacccccgcccacatccccccccaacccgcaccaccagcacgggttgggggtagcaggggatcaaaggggggcaaagcggcggggcggttcggggggggggggggggggcgggaaaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcggcgctcctcgccgccctagaggctggtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgtttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccagccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgttcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggacggcgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcctccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacagatgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgatgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagaccgagggccgacccgggccgtggccgagatcgtctggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcgcgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacatgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgttgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccacctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaaaaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttctgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacggcgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgcgcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaatttctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtcgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgtgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccggcggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgccgccaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggtttgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtgcgcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcagtcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgataacaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgcgggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgtgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcactgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttccgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcatgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggttctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgaacccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacgaccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtttcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccgcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcaccgtcgtccaggtcgtcgtcatcctcgtccgtggtgggctccgggtgggtgggcgacagggccctcaccgtgtgcccccccagggtcaggtaccgcggggcgaaccgctgattgcccgtccagataaagtccacggccgtgcccgccctgacggcctcctcggcctccatgcgggtctgggggtcgttcacgatcgggatggtgctgaacgacccgctgggcgtcacgcccactatcaggtacaccagcttggcgttgcacagcgggcaggtgttgcgcaattgcatccaggttttcatgcacgggatgcagaagcggtgcatgcacgggaaggtgtcgcagcgcaggtggggcgcgatctcatccgtgcacacggcgcacacgtcgccctcgtcgctccccccgtcctctcgagggggggcgcccccgcaactgccggggtcttcctcgcggggggggctcccccccgagaccgcccccccatccacgccctgcggccccagcagccccgtctcgaacagttccgtgtccgtgctgtccgcctcggaggcggagtcgtcgtcatggtggtcggcgtccccccgcccccccacttcggtctccgcctcagagtcgctgctgtccggcaggtctcggtcgcagggaaacacccagacatccggggcgggctaaggggaaaaaaggggggcgggtaagaatggggggggatttcccgcgtcaatcagcacccacgagttccccctctcccccccccgcctcacaaagtcctgcccccctgctggcctcggaagaggggggagaaaggggtctgcaaccaaaggtggtctgggtccgtcctttggatcccgacccctcttcttccctcttctcccgccctccagacgcaccggagtcgggggtcccacggcgtcccccaaatatggcgggcggctcctccccacccccctagatgcgtgtgagtaaggggggcctgcgtatgagtcagtggggaccacgcccccaacacggcgaccccggtccttgtgtgtttgttgtgggggcgtgtctctgtgtatgagtcagggggtcccacggcgaccccgggccctgcgtctgagtcaaaggggccatgtgtatgtgttgggggtctgtatatataaagtcagggggtcacatggcgacccccaacagggcgaccccggtccctgtatatatagggtcagggggttccgcaccccctaacatggcgcccccggtccctgtatatatagtgtcacggggttccacgccccctaacatggcgccccaacatggcgcccggctcccgtgtatgagtgggggtcccccaacatggcggccggttccagtgtaagggtcgggggtcccccaacatggcgccccccaatatggcgccccccaatatggcgccccagacatggcgcccggcccctcacctcgcgctgggggcggccctcaggccggcgggtactcgctccggggcggggctccatgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcggcccgccctgtgagggcgggctggctccaagcgtatatatgcgcggctcctgccatcgtctctccggagagcggcttggtgcggagctccaccgcggtggcggccgctctagagtggggagaaggggtctgggctcgccaggggggcatacttgcccgggctatacagacccgcgagccgtacgtggttcgcggggggtgcgtggggtccggggctcccggggagaccggggctccctgggagaccggggttgtcgtggatccctggggtcacgcggtaccctggggtctctgggatctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttacaagcttcggggagaggcaccgaagcgtgaccgtggttggaacacggctgcacaccaccaccggccgggtggtggatgtccttatacccgtggtgccggggccggctctcccaaacccctcctcgttccgccccccgggcggggcccccgccccacctccggcacagacaaggaccaatcagacaccataagtacgtggcatgtatttaattagcatatcacataccccgttccgcttccgcggggacccgggcgggggtggatacgctggctgggttggtcttggtaacgggacggccaattgggacccatgggcggggtcgttgggatccaggctacacgtggcctcgggggaccgattttcatttgcatatgacgcgtcgggtgggtgggccccaagacaggacagtttccaatttgcatatgccgttacggtttccgccggcctggatgtgacgtcatacatcaaacaggcgcctctggatctcctgctcgtagtgaagcgccacgagcaccaccccggccaccacggcgatataacacaatcgcactgcgatgcccgagaggatgatggaacagcagcgcccgcagacgcccgacagccccttggatcgccccggggcggcggccttgtctgcgttcttgggggccgggccccgccgcagaatacaatacagctctgtcaggccgatggtggagacaaaacaccaggtggtgatggtcagaaacagggggtatgtgatcgcacatgccccccgggatatgaaagcggtgccgacgatgagacccacggccacaaagcgtagcatcaactcgcagcctacgatgaccccgatggcggggcggtggtacaagaaggtgaccgggtccgtctcaaacaactgaaccaggttttgccgctggaccgacagctcgcagagcaggcgggtaattttcgtgtaggggtactgcaggaacacgctcgatacgatgcggcctgcgtagttcaagaggtaggtggccggggccaccatcttgtgggcgggactcacgacgccaaacatacatcggcgttggtggagggcgacgaacgccagatacaggaaccaccctacgaccaccagacgcacccgtgtgtaccatagggtctccagacagttaactgcctcgtggacgttcatgatccgacgattcatggcgtcaggtgggacctggaagggcacgaccctacccgcgataagattggcgtagcagatatgggcgtggttgcgccagcccccgttgggggggtgcgtcggggcccccagaaacaatagggtctggttcattttcatccacacgagggcggtgtcgttgttggtgccggtggggcgtaccgcgtaaatacatcggtgcagcggactggcaccgaagacggtgtaccacacgagcacgaggccgtacgccgttatcaagacgacggttgagaggtgctgcagggaacggacggcgagcatggcgtgccggcgtcaatggtaaacagcgtgtgcaggcggttgctgtcgcatttggcggcaaagcactgctgacacaaggacacgcacaggcggttgttggccccgacgctcagcgcgacgaatgtccgcgccgtggcgcgactcgcccggccgtgcttaaagcgcagacacgacaggctttgctgcaggcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatccgctagcgctaccggtcgccaccatgtggctgcagaatttacttttcctgggcattgtggtctacagcctctcagcacccacccgctcacccatcactgtcacccggccttggaagcatgtagaggccatcaaagaagccctgaacctcctggatgacatgcctgtcacattgaatgaagaggtagaagtcgtctctaacgagttctccttcaagaagctaacatgtgtgcagacccgcctgaagatattcgagcagggtctacggggcaatttcaccaaactcaagggcgccttgaacatgacagccagctactaccagacatactgccccccaactccggaaacggactgtgaaacacaagttaccacctatgcggatttcatagacagccttaaaacctttctgactgatatcccctttgaatgcaaaaaaccagtccaaaaatgaggaagcccaggccagctcgagcatgcagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggtctagataccacatttgtagaggttttacttgctttaaaaaacctcccacatctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgctcgaagcattaaccctcactaaagggaatcagccccgcccccgcgactcctttttattgggcccgctggcgcccatgagcctaaagcaaagcccgtacgcgtacagggccacggcgaccattaccgcggtcagggccacgtaaaaaacaaccagggcctgcggtggctccgagagcggcaccccgcgcgcgtagcagcctgcgctccaaaagtccattgccccctcgcgccgcatcgcgtctagcagggggtcgcggccgcgcacgatggcaaacagcgcggcggccacaaccgcaacgatgagcggcgaccggcggcatggtggcgaccggtagatcctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaagccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcacgcatgctcttctccacctcagtgatgacgagagcgggcgggtgagggggcgggaacgcagcgatctctgggttctacgttagtgggagtttaacgacggtccctgggattccccaaggcaggggcgagtccttttgtatgaattactcggatccttaattaaaaagggccgcgcgcgacccccggggggtgtgttttggggggggcccgttttcggcgtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgccccctccccagccccagccctccccagccccagccctccccggccccagccctccccggccccagccctccccggccccagccctccccggccccagccctccccggccccagccctccccggccccagccctccccggcgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcggcgtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccaattgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacacggccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggtcgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtcccccctcctccgcccccgcgtcccccctcctccacccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcgacctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggccgtgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaattggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcacgccgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcgccggggagggctggggccggggagggctggggccggggagggctggggccggggagggctggggccggggagggctggggccggggagggctggggccggggagggctggggctggggagggctggggctggggagggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagacgccgaaaacgggccccccccaaaacacaccccccgggggtcgcgcgcggccctttaaagcggtggcggcgggc

SEQ ID NO: 31 - DNA, 21 bp, Artificial Sequence
  Primer
ctgtcacccggccttggaagc

SEQ ID NO: 32 - DNA, 22 bp, Artificial Sequence
  Primer
acaggcatgtcatccaggaggt

SEQ ID NO: 33 - DNA, 22 bp, Artificial Sequence
  Primer
tcggcgtggaagaaacgagaga

SEQ ID NO: 34 - DNA, 20 bp, Artificial Sequence
  Primer
cgaacgcacccaaatcgaca

What is claimed is:

1. A variant oncolytic herpes simplex virus (HSV) comprising:
    (a) functionally inactive ICP34.5 encoding genes;
    (b) a US11 encoding gene operably associated with an immediate early (IE) promoter; and
    (c) a virus-derived heterologous transporter associated with antigen presentation (TAP) inhibitor.

2. The variant HSV of claim 1, wherein the variant HSV is derived from HSV-1.

3. The variant HSV of claim 2, wherein the variant HSV is derived from wild-type HSV-1, HSV-1 strain F, HSV-1 strain 17, HSV-1 KOS, HSV-1 strain Patton, or a HSV-1 clinical strain.

4. The variant HSV of claim 1, wherein the variant HSV is at least 70% identical to HSV-1 or HSV-2.

5. The variant HSV of claim 1, wherein the variant HSV is at least 70% identical to SEQ ID NO: 1.

6. The variant HSV of claim 1, wherein the heterologous TAP inhibitor is a herpes virus UL49.5 polypeptide, a CMV US6 polypeptide, or a BNLF2a polypeptide.

7. The variant HSV of claim 6, wherein the UL49.5 polypeptide is derived from bovine herpes virus, pseudorabies virus, equine herpes virus 1, equine herpes virus 4, bubaline herpesvirus 1, cervid herpes virus 1, or felid herpesvirus 1.

8. The variant HSV according to claim 6, wherein the UL49.5 polypeptide is derived from bovine herpesvirus.

9. The variant HSV of claim 1, wherein the ICP34.5 genes are rendered functionally inactive by deletion, substitution, or insertion.

10. The variant HSV of claim 1, wherein at least one of the ICP34.5 genes is rendered functionally inactive by the insertion of an expression cassette.

11. The variant HSV of claim 1, wherein at least one of the ICP34.5 genes is rendered functionally inactive without the insertion of an expression cassette.

12. The variant HSV of claim 1, wherein the variant HSV comprises an intact US12 encoding gene.

13. The variant HSV of claim 1, wherein the variant HSV comprises an additional US11 encoding gene operably associated with a late promoter.

14. The variant HSV of claim 1, wherein the IE promoter is an α27 IE promoter.

15. The variant HSV of claim 1, wherein the variant HSV further comprises an additional heterologous gene.

16. The variant HSV of claim 15, wherein the heterologous gene encodes an immunomodulatory polypeptide selected from granulocyte macrophage colony stimulating factor (GM-CSF), tumor necrosis factor (TNF)-alpha, CD40 ligand (CD40L), a pro-drug converting enzyme, IL-I, IL-2, IL-3, IL-4, IL-5, IL-6, IL-7, IL-8, IL-9, IL-10, IL-11, IL-12, IL-13, IL-14, IL-15, IL-16, IL-17, IL-18, G-CSF, IFN-α, IFN-γ, IL-20 (MDA-7), a costimulatory molecule, B7-1 (CD80), and B7-2 (CD86).

17. The variant HSV of claim 15, wherein the heterologous gene is a GM-CSF gene.

18. The variant HSV of claim 15, wherein the heterologous gene is a pro-drug converting enzyme.

19. The variant HSV of claim 15, wherein the heterologous gene is operably associated with a cellular or viral promoter.

20. The variant HSV of claim 19, wherein the promoter is a CMV promoter, a MMLV LTR promoter, a RSV promoter, or an EF1α promoter.

21. The variant HSV of claim 15, wherein the heterologous gene is operably associated with an inducible promoter.

22. The variant HSV of claim 15, comprising:
(a) functionally inactive ICP34.5 encoding genes;
(b) a US11 encoding gene operably associated with an immediate early (IE) promoter;
(c) a gene encoding a UL49.5 polypeptide; and
(d) a gene encoding GM-CSF.

23. The variant HSV of claim 22, wherein the gene encoding the UL49.5 polypeptide is derived from bovine herpesvirus.

24. The variant HSV of claim 23, wherein the GM-CSF gene is operably associated with a CMV promoter.

25. The variant HSV of claim 1, having a genome sequence set forth in SEQ ID NO: 26, SEQ ID NO: 27, SEQ ID NO: 28, SEQ ID NO: 29, or SEQ ID NO: 30.

26. The variant HSV of claim 1, wherein the variant HSV comprises a nucleic acid sequence set forth in one of SEQ ID NO: 21, SEQ ID NO: 22, SEQ ID NO: 23, SEQ ID NO: 24 and SEQ ID NO: 25.

27. A pharmaceutical formulation comprising the variant HSV of claim 1 and a pharmaceutically acceptable carrier.

28. A method of treating a patient suffering from cancer comprising administering to the patient the pharmaceutical composition of claim 27.

29. The method of claim 28, wherein the cancer is selected from breast, brain, cervix, colon, head & neck, liver, kidney, lung, non-small cell lung, melanoma, mesothelioma, ovary, sarcoma, stomach, uterus and Medulloblastoma, Hodgkin's Disease, Non-Hodgkin's Lymphoma, multiple myeloma, neuroblastoma, ovarian cancer, rhabdomyosarcoma, primary thrombocytosis, primary macroglobulinemia, primary brain tumors, malignant pancreatic insulanoma, malignant carcinoid, urinary bladder cancer, premalignant skin lesions, testicular cancer, lymphomas, thyroid cancer, neuroblastoma, esophageal cancer, genitourinary tract cancer, malignant hypercalcemia, endometrial cancer, adrenal cortical cancer, neoplasms of the endocrine and exocrine pancreas, and prostate cancer.

30. The variant HSV of claim 17, wherein the GM-CSF gene is human GM-CSF.

31. The variant HSV of claim 22, wherein the GM-CSF gene is human GM-CSF.

32. The variant HSV of claim 22, wherein the UL49.5 polypeptide is operably associated with a cellular or viral promoter.

33. The variant HSV of claim 32, wherein the promoter is a CMV promoter, a MMLV LTR promoter, a RSV promoter, or an EF1α promoter.

34. The variant HSV according to claim 22, wherein UL49.5 polypeptide is derived from bovine herpes virus operably associated with a CMV promoter and wherein GM-CSF is human GM-CSF.

35. The variant HSV of claim 24, wherein GM-CSF is human GM-CSF.

36. The variant HSV of claim 1, wherein the heterologous TAP inhibitor is operably associated with a cellular or viral promoter.

37. The variant HSV of claim 36, wherein the promoter is a CMV promoter, a MMLV LTR promoter, a RSV promoter, or an EF1α promoter.

38. The variant HSV according to claim 37, wherein the heterologous TAP inhibitor is UL49.5 polypeptide derived from bovine herpes virus, pseudorabies virus, equine herpes virus 1, equine herpes virus 4, bubaline herpesvirus 1, cervid herpes virus 1, or felid herpesvirus 1.

39. The variant HSV according to claim 38, wherein the UL49.5 polypeptide is derived from bovine herpesvirus and is operably associated with a CMV promoter.

40. The variant HSV according to claim 39, wherein the HSV variant also comprises IL-12.

41. The variant HSV according to claim 40, wherein IL-12 is human IL-12.

42. The variant HSV of claim 1, wherein the IE promoter is selected from an α0, α4, α22, α27 or α47 IE promoter.

43. The variant HSV of claim 1, wherein the IE promoter is a CMV promoter.

44. The variant HSV of claim 43, wherein the heterologous TAP inhibitor is inserted downstream from the US11 encoding gene.

45. The variant HSV of claim 44, wherein the heterologous TAP inhibitor is inserted in the same orientation as the US11 encoding gene.

46. The variant HSV of claim 45, wherein the variant HSV further comprises an additional heterologous gene.

47. The variant HSV of claim 46, wherein the additional heterologous gene is inserted downstream from the US11 encoding gene.

48. The variant HSV of claim 47, wherein the additional heterologous gene is inserted in the same orientation as the US11 encoding gene.

49. The variant HSV of claim 48, wherein the additional heterologous gene is human GM-CSF.

50. The variant HSV of claim 49, wherein the heterologous TAP inhibitor and human GM-CSF are operably associated with the same promoter.

51. The variant HSV of claim 50, wherein the promoter is the CMV promoter.

52. The variant HSV of claim 22, wherein the IE promoter is selected from an α0, α4, α22, α27 or α47 IE promoter.

53. The variant HSV of claim 22, wherein the IE promoter is a CMV promoter.

54. The variant HSV of claim 53, wherein the UL49.5 polypeptide is inserted downstream from the US 11 encoding gene.

55. The variant HSV of claim 54, wherein the UL49.5 polypeptide is inserted in the same orientation as the US 11 encoding gene.

56. The variant HSV of claim 55, wherein the GM-CSF gene is inserted downstream from the US11 encoding gene.

57. The variant HSV of claim 56, wherein the GM-CSF gene is inserted in the same orientation as the US11 encoding gene.

58. The variant HSV of claim 57, wherein the GM-CSF gene is human GM-CSF.

59. The variant HSV of claim 58, wherein the UL49.5 polypeptide and the human GM-CSF gene are operably associated with the same promoter.

60. The variant HSV of claim 59, wherein the promoter is the CMV promoter.

61. The variant HSV of claim 22, wherein the IE promoter is an α27 IE promoter.

62. The variant HSV of claim 61, wherein the GM-CSF gene is human GM-CSF.

63. The variant HSV of claim 62, wherein the UL49.5 polypeptide and the human GM-CSF gene are operably associated with the same promoter.

64. The variant HSV of claim 63, wherein the promoter is the CMV promoter.

* * * * *